United States Patent
Zhang et al.

(10) Patent No.: US 11,788,083 B2
(45) Date of Patent: Oct. 17, 2023

(54) TYPE VI CRISPR ORTHOLOGS AND SYSTEMS

(71) Applicants: The Broad Institute, Inc., Cambridge, MA (US); Massachusetts Institute of Technology, Cambridge, MA (US); President and Fellows of Harvard College, Cambridge, MA (US)

(72) Inventors: Feng Zhang, Cambridge, MA (US); Omar O. Abudayyeh, Cambridge, MA (US); Jonathan Gootenberg, Cambridge, MA (US); Eric S. Lander, Cambridge, MA (US)

(73) Assignees: The Broad Institute, Inc., Cambridge, MA (US); Massachusetts Institute of Technology, Cambridge, MA (US); President and Fellows of Harvard College, Cambridge, MA (US)

( * ) Notice: Subject to any disclaimer, the term of this patent is extended or adjusted under 35 U.S.C. 154(b) by 900 days.

(21) Appl. No.: 16/310,577

(22) PCT Filed: Jun. 19, 2017

(86) PCT No.: PCT/US2017/038154
§ 371 (c)(1),
(2) Date: Dec. 17, 2018

(87) PCT Pub. No.: WO2017/219027
PCT Pub. Date: Dec. 21, 2017

(65) Prior Publication Data
US 2019/0359971 A1    Nov. 28, 2019

Related U.S. Application Data

(60) Provisional application No. 62/484,786, filed on Apr. 12, 2017, provisional application No. 62/471,792, filed on Mar. 15, 2017, provisional application No. 62/432,240, filed on Dec. 9, 2016, provisional application No. 62/410,366, filed on Oct. 19, 2016, provisional application No. 62/376,377, filed on Aug. 17, 2016, provisional application No. 62/351,803, filed on Jun. 17, 2016, provisional application No. 62/351,662, filed on Jun. 17, 2016.

(51) Int. Cl.
| | |
|---|---|
| *C12N 15/10* | (2006.01) |
| *C12N 9/22* | (2006.01) |
| *C12N 15/11* | (2006.01) |
| *C12N 15/85* | (2006.01) |
| *C12N 15/82* | (2006.01) |
| *C12N 15/113* | (2010.01) |

(52) U.S. Cl.
CPC ............. *C12N 15/102* (2013.01); *C12N 9/22* (2013.01); *C12N 15/111* (2013.01); *C12N 15/113* (2013.01); *C12N 15/8213* (2013.01); *C12N 15/8509* (2013.01); *C12N 2310/20* (2017.05); *C12N 2800/22* (2013.01)

(58) Field of Classification Search
None
See application file for complete search history.

(56) References Cited

U.S. PATENT DOCUMENTS

| | | |
|---|---|---|
| 4,186,183 A | 1/1980 | Alving et al. |
| 4,217,344 A | 8/1980 | Handjani et al. |
| 4,235,871 A | 11/1980 | Papahadjopoulos et al. |
| 4,261,975 A | 4/1981 | Fullerton et al. |
| 4,485,054 A | 11/1984 | Mezei et al. |
| 4,501,728 A | 2/1985 | Geho et al. |
| 4,774,085 A | 9/1988 | Fidler |
| 4,797,368 A | 1/1989 | Carter et al. |
| 4,837,028 A | 6/1989 | Allen |
| 4,873,316 A | 10/1989 | Meade et al. |
| 4,897,355 A | 1/1990 | Eppstein et al. |
| 4,946,787 A | 8/1990 | Eppstein et al. |
| 5,049,386 A | 9/1991 | Eppstein et al. |
| 5,173,414 A | 12/1992 | Lebkowski et al. |
| 5,210,015 A | 5/1993 | Gelfand et al. |
| 5,445,934 A | 8/1995 | Fodor et al. |
| 5,543,158 A | 8/1996 | Gref et al. |
| 5,580,859 A | 12/1996 | Felgner et al. |
| 5,589,466 A | 12/1996 | Felgner et al. |
| 5,593,972 A | 1/1997 | Weiner et al. |

(Continued)

FOREIGN PATENT DOCUMENTS

| | | |
|---|---|---|
| EP | 1 519 714 A1 | 4/2005 |
| EP | 1 664 316 A1 | 6/2006 |

(Continued)

OTHER PUBLICATIONS

Shmakov et al., Diversity and evolution of class 2 CRISPR-Cas systems. Nature Reviews Microbiology (2017) 15:169-180 (Year: 2017).*
NCBI Alignment, https://blast.ncbi.nlm.nih.gov/Blast.cgi. Retrieved from internet Jan. 26, 2022 (Year: 2022).*
Addgene plasmid # 91902, pC014—LwCas13a-msfGFP, retrieved from internet [retrieved Jan. 26, 2022] (Year: 2022).*
Abudayyeh et al., RNA targeting with CRISPR-Cas13. Nature (2017) 550: 280-284, and Supplemental Material, (Year: 2017).*
Shmakov et al., Discovery and Functional Characterization of Diverse Class 2 CRISPR-Cas Systems. Molecular Cell (2015) 60, 385-397 (Year: 2015).*
Koonin et al., Diversity, classification and evolution of CRISPR-Cas systems. Current Opinion in Microbiology 2017, 37:67-78 (Year: 2017).*

(Continued)

*Primary Examiner* — Samuel C Woolwine
*Assistant Examiner* — Catherine Konopka
(74) *Attorney, Agent, or Firm* — F. Brent Nix, Esq.; Johnson, Marcou, Isaacs & Nix, LLC

(57) ABSTRACT

The invention provides for systems, methods, and compositions for targeting nucleic acids. In particular, the invention provides non-naturally occurring or engineered RNA-targeting systems comprising a novel RNA-targeting CRISPR effector protein and at least one targeting nucleic acid component like a guide RNA.

26 Claims, 137 Drawing Sheets

Specification includes a Sequence Listing.

(56) References Cited

U.S. PATENT DOCUMENTS

| | | |
|---|---|---|
| 5,789,156 A | 8/1998 | Bujard et al. |
| 5,814,618 A | 9/1998 | Bujard et al. |
| 5,846,946 A | 12/1998 | Huebner et al. |
| 5,855,913 A | 1/1999 | Hanes et al. |
| 5,985,309 A | 11/1999 | Edwards et al. |
| 6,007,845 A | 12/1999 | Domb et al. |
| 6,603,061 B1 | 8/2003 | Armstrong et al. |
| 6,750,059 B1 | 6/2004 | Blakesley et al. |
| 7,259,015 B2 | 8/2007 | Kingsman et al. |
| 7,303,910 B2 | 12/2007 | Bebbington et al. |
| 7,351,585 B2 | 4/2008 | Mitrophanous et al. |
| 7,745,651 B2 | 6/2010 | Heyes et al. |
| 7,776,321 B2 | 8/2010 | Cascalho et al. |
| 7,799,565 B2 | 9/2010 | Maclachlan et al. |
| 7,803,397 B2 | 9/2010 | Heyes et al. |
| 7,838,658 B2 | 11/2010 | Maclachlan et al. |
| 7,868,149 B2 | 1/2011 | Boukharov et al. |
| 7,901,708 B2 | 3/2011 | Maclachlan et al. |
| 7,915,399 B2 | 3/2011 | Maclachlan et al. |
| 7,982,027 B2 | 7/2011 | Maclachlan et al. |
| 8,044,019 B2 | 10/2011 | Uno et al. |
| 8,058,069 B2 | 11/2011 | Yaworski et al. |
| 8,101,741 B2 | 1/2012 | Maclachlan et al. |
| 8,188,263 B2 | 5/2012 | Maclachlan et al. |
| 8,236,943 B2 | 8/2012 | Lee et al. |
| 8,283,333 B2 | 10/2012 | Yaworski et al. |
| 8,372,951 B2 | 2/2013 | Chang et al. |
| 8,404,658 B2 | 3/2013 | Hajjar et al. |
| 8,454,972 B2 | 6/2013 | Nabel et al. |
| 8,575,305 B2 | 11/2013 | Gait et al. |
| 8,614,194 B1 | 12/2013 | Chen et al. |
| 8,697,359 B1 | 4/2014 | Zhang |
| 8,709,843 B2 | 4/2014 | Shakuda |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 9,790,490 B2 * | 10/2017 | Zhang ............... C12N 15/102 |
| 10,266,887 B2 * | 4/2019 | Abudayyeh ........ C12Q 1/6811 |
| 11,021,740 B2 * | 6/2021 | Abudayyeh ........ B01L 3/5023 |
| 11,174,515 B2 * | 11/2021 | Abudayyeh ........ C12Q 1/6804 |
| 2003/0087817 A1 | 5/2003 | Cox et al. |
| 2004/0013648 A1 | 1/2004 | Kingsman et al. |
| 2004/0142476 A1 | 7/2004 | Evans et al. |
| 2004/0171156 A1 | 9/2004 | Hartley et al. |
| 2005/0019923 A1 | 1/2005 | Uchegbu et al. |
| 2006/0281180 A1 | 12/2006 | Radcliffe et al. |
| 2007/0025970 A1 | 2/2007 | Kingsman et al. |
| 2007/0054961 A1 | 3/2007 | Maden et al. |
| 2008/0267903 A1 | 10/2008 | Uchegbu et al. |
| 2009/0007284 A1 | 1/2009 | Radcliffe et al. |
| 2009/0017543 A1 | 1/2009 | Wilkes et al. |
| 2009/0100536 A1 | 4/2009 | Adams et al. |
| 2009/0111106 A1 | 4/2009 | Mitrophanous et al. |
| 2010/0317109 A1 | 12/2010 | Maden et al. |
| 2011/0027239 A1 | 2/2011 | Paek |
| 2011/0059502 A1 | 3/2011 | Chalasani |
| 2011/0117189 A1 | 5/2011 | Mazzone et al. |
| 2011/0195123 A1 | 8/2011 | Shemi |
| 2011/0293571 A1 | 12/2011 | Widdowson et al. |
| 2011/0293703 A1 | 12/2011 | Mahon et al. |
| 2012/0003201 A1 | 1/2012 | Nicholas et al. |
| 2012/0251560 A1 | 10/2012 | Dahlman et al. |
| 2012/0295960 A1 | 11/2012 | Palfi et al. |
| 2013/0185823 A1 | 7/2013 | Kuang et al. |
| 2013/0244279 A1 | 9/2013 | De Fougerolles et al. |
| 2013/0245107 A1 | 9/2013 | De Fougerolles et al. |
| 2013/0252281 A1 | 9/2013 | De Fougerolles et al. |
| 2013/0302401 A1 | 11/2013 | Ma et al. |
| 2014/0068797 A1 * | 3/2014 | Doudna ............... C12N 15/746<br>435/375 |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0227787 A1 | 8/2014 | Zhang |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273231 A1 | 9/2014 | Zhang et al. |
| 2014/0273232 A1 | 9/2014 | Zhang et al. |
| 2014/0273234 A1 | 9/2014 | Zhang et al. |
| 2014/0287938 A1 | 9/2014 | Zhang et al. |
| 2014/0310830 A1 | 10/2014 | Zhang et al. |
| 2014/0335620 A1 | 11/2014 | Zhang et al. |
| 2014/0357530 A1 | 12/2014 | Zhang et al. |
| 2017/0211142 A1 * | 7/2017 | Smargon ............... C12N 15/74 |
| 2017/0306303 A1 * | 10/2017 | Taunton ............... C07K 14/72 |
| 2017/0321198 A1 * | 11/2017 | Severinov ............. C12N 9/22 |
| 2017/0362644 A1 * | 12/2017 | Doudna ............... C12Q 1/6823 |
| 2018/0112234 A9 * | 4/2018 | Dombrowski ........ C12N 15/86 |
| 2018/0363009 A1 * | 12/2018 | Doudna ............... C12N 15/907 |
| 2019/0010519 A1 * | 1/2019 | Corn ................... C12N 15/907 |
| 2019/0038776 A1 * | 2/2019 | Pyle ................... A61K 48/0066 |
| 2019/0093128 A1 * | 3/2019 | Chen ................... C12N 15/873 |
| 2019/0136231 A1 * | 5/2019 | Morrissey ............. C12N 9/22 |
| 2019/0194632 A1 * | 6/2019 | Thorner ............... C12N 15/09 |
| 2020/0149064 A1 * | 5/2020 | Schaffer ............... C12N 15/86 |

FOREIGN PATENT DOCUMENTS

| | | |
|---|---|---|
| EP | 1 766 035 A1 | 3/2007 |
| EP | 1 781 593 A2 | 5/2007 |
| EP | 2784162 A1 | 10/2014 |
| EP | 2 771 468 B1 | 2/2015 |
| EP | 2 764 103 B1 | 8/2015 |
| JP | 2016-500003 A | 1/2016 |
| JP | 2016-504026 A | 2/2016 |
| WO | 91/16024 A1 | 10/1991 |
| WO | 91/17424 A1 | 11/1991 |
| WO | 93/01294 A1 | 1/1993 |
| WO | 93/24641 A2 | 12/1993 |
| WO | 94/26877 A1 | 11/1994 |
| WO | 96/39154 A1 | 12/1996 |
| WO | 97/03211 A1 | 1/1997 |
| WO | 2008/042156 A1 | 4/2008 |
| WO | 2008/064289 A2 | 5/2008 |
| WO | 2010/061186 A2 | 6/2010 |
| WO | 2010/096488 A1 | 8/2010 |
| WO | 2011/028929 A3 | 10/2011 |
| WO | 2012/135025 A2 | 10/2012 |
| WO | 2013/033436 A1 | 3/2013 |
| WO | 2014/018423 A2 | 1/2014 |
| WO | 2014/065596 A1 | 5/2014 |
| WO | 2014/093595 A1 | 6/2014 |
| WO | 2014/093622 A2 | 6/2014 |
| WO | 2014/093635 A1 | 6/2014 |
| WO | 2014/093655 A2 | 6/2014 |
| WO | 2014/093661 A2 | 6/2014 |
| WO | 2014/093694 A1 | 6/2014 |
| WO | 2014/093701 A1 | 6/2014 |
| WO | 2014/093709 A1 | 6/2014 |
| WO | 2014/093712 A1 | 6/2014 |
| WO | 2014/093718 A1 | 6/2014 |
| WO | 2014/204723 A1 | 12/2014 |
| WO | 2014/204724 A1 | 12/2014 |
| WO | 2014/204725 A1 | 12/2014 |
| WO | 2014/204726 A1 | 12/2014 |
| WO | 2014/204727 A1 | 12/2014 |
| WO | 2014/204728 A1 | 12/2014 |

(56) References Cited

FOREIGN PATENT DOCUMENTS

| WO | 2014/204729 A1 | 12/2014 |
| WO | 2015/065964 A1 | 5/2015 |
| WO | 2015/089419 A2 | 6/2015 |
| WO | 2016205764 A1 | 12/2016 |
| WO | 2017/218573 A1 | 12/2017 |

OTHER PUBLICATIONS

Makarova et al., Evolutionary classification of CRISPR-Cas systems: a burst of class 2 and derived variants. Nature Review Microbiology (2020) 18:67-83 (Year: 2020).*

Hoikkala et al., Cooperation between Different CRISPR-Cas Types Enables Adaptation in an RNA-Targeting System. mBio (2021) 12(2): 1-18 (Year: 2021).*

Abudayyeh et al., C2c2 is a single-component programmable RNA-guided RNA-targeting CRISPR effector. Science (2016), 353(6299): aaf5573-1-aaf5573-9 (Year: 2016).*

C2c2-2 through C2c2-16 CLUSTL sequence alignment and percent identity matrix. https://www.ebi.ac.uk/Tools/msa/clustalo/ [Retrieved from internet Feb. 1, 2022] (Year: 2022).*

C2c2-2 through C2c2-34 CLUSTL sequence alignment and percent identity matrix. https://www.ebi.ac.uk/Tools/msa/clustalo/ [Retrieved from internet Feb. 1, 2022] (Year: 2022).*

The Broad Institute, Inc., "Communication pursuant to Article 94(3) EPC for EP 17736810.7", dated May 15, 2020, 5 pages.

The Broad Institute, Inc., "Notice of Grounds for Rejection for Korean Patent Application No. 10-2019-7001527", dated Aug. 26, 2021, 13 pages.

The Broad Institute, Inc., "International Preliminary Report on Patentability issued in International Application No. PCT/US2017/038154", dated Dec. 27, 2018, 8 pages.

The Broad Institute, Inc., "Notice of Reasons for Rejection for JP 2018-566199", dated Jul. 20, 2021, 12 pages.

Abil, et al., "Engineering Reprogrammable RNA-Binding Proteins for Study and Manipulation of the Transcriptome", Molecular BioSystems, The Royal Society of Chemistry, vol. 11, No. 10, 2015, 8 pages.

Banaszynski, et al., "A Rapid, Reversible, and Tunable Method to Regulate Protein Function in Living Cells Using Synthetic Small Molecules", Cell, vol. 126, No. 5, Sep. 8, 2006, 995-1004.

Banaszynski, et al., "Chemical Control of Protein Stability and Function in Living Animals", Nature Medicine, vol. 14, No. 10, Oct. 2008, 13 pages.

Besemer, et al., "GeneMarkS: A Self-Training Method for Prediction of Gene Starts in Microbial Genomes. Implications for Finding Sequence Motifs in Regulatory Regions", Nucleic Acids Research, vol. 29, No. 12, 2001, 2607-2618.

Canver, et al., "BCL11A Enhancer Dissection by Cas9-Mediated In Situ Saturating Mutagenesis", Nature, vol. 527, No. 7577, Nov. 12, 2015, 192-197.

Edgar, et al., "PILER-CR: Fast and Accurate Identification of CRISPR Repeats", BMC Bioinformatics, 2007, vol. 8, No. 18, Jan. 20, 2007, 6 pages.

Resch-Genger, et al., "Quantum Dots Versus Organic Dyes as Fluorescent Labels", Nature Methods, 2008, vol. 5, No. 9, Sep. 2008, 763-775.

Gootenberg, et al., "Nucleic Acid Detection With CRISPR-Cas13a/C2c2", Science, vol. 356, No. 6336, Apr. 28, 2017, 12 pages.

Hsu, et al., "DNA Targeting Specificity of Rna-Guided Cas9 Nucleases", Nature Biotechnology, vol. 31, No. 9, Sep. 2013, 827-832.

Kleinstiver, et al., "High-Fidelity CRISPR-Cas9 Nucleases with No Detectable Genome-Wide Off-Target Effects", Nature, vol. 529, No. 7587, Jan. 2016, 17 pages.

Konermann, et al., "Genome-Scale Transcriptional Activation by an Engineered CRISPR-Cas9 Complex", Nature, vol. 517, No. 7536, Jan. 29, 2015, 18 pages.

Liu, et al., "Two Distant Catalytic Sites Are Responsible for C2c2 RNase Activities", Cell, vol. 168, No. 1-2, Jan. 2017, 121-134.

Mackay, et al., "The Prospects for Designer Single-Stranded RNA-Binding Proteins", Nature Structural & Molecular Biology, vol. 18, No. 3, Mar. 2011, 256-261.

Miyazaki, et al., "Destabilizing Domains Derived from the Human Estrogen Receptor", Journal of the American Chemical Society, vol. 134, No. 9, Mar. 7, 2012, 3942-3945.

Platt, et al., "CRISPR-Cas9 Knockin Mice for Genome Editing and Cancer Modeling", Cell, vol. 159, No. 2, Oct. 9, 2014, 31 pages.

Ran, et al., "In Vivo Genome Editing Using *Staphylococcus aureus* Cas9", Nature, vol. 520, No. 7546, Apr. 9, 2015, 28 pages.

Rodriguez, et al., "Targeted Chemical-Genetic Regulation of Protein Stability In Vivo", Chemistry & Biology, vol. 19, No. 3, Mar. 23, 2012, 391-398.

Shmakov, et al., "Diversity and Evolution of Class 2 CRISPR-Cas Systems", Nature Reviews Microbiology, vol. 15, No. 3, Mar. 2017, 30 pages.

Slaymaker, et al., "Rationally Engineered Cas9 Nucleases with Improved Specificity", Science, vol. 351, No. 6268, Jan. 1, 2016, 84-88.

Smargon, et al., "Cas 13B is a Type VI-B CRISPR-Associated RNA-Guided RNAse Differentially Regulated by Accessory Proteins Csx27 and Csx28", Molecular Cell, vol. 65, No. 4, Feb. 16, 2017, 30 pages.

Maynard-Smith, et al., "A directed approach for engineering conditional protein stability using biologically silent small molecules", The Journal of Biological Chemistry, 2007, vol. 282, Aug. 24, 2007, 13 pages.

Zinn, et al., "In Silico Reconstruction of the Viral Evolutionary Lineage Yields a Potent Gene Therapy Vector", Cell Reports, vol. 12, No. 6, Aug. 11, 2015, 25 pages.

The Broad Institute, Inc, "Examination Report No. 2 for Standard Patent Application for AU 2017283713", dated Dec. 8, 2020, 6 pages.

The Broad Institute, Inc, "Examination Report No. 2 for Standard Patent Application for AU 2018271372", dated Dec. 17, 2020, 17 pages.

Abudayyeh, et al., "C2c2 is a single-component programmable RNA-guided RNA-targeting CRISPR effector", bioRxiv, May 21, 2016, 31 pages.

The Broad Institute, Inc., "Examination Report No. 1 for Standard Patent Application for AU 2017283713", dated Jun. 5, 2020, 5 pages.

The Broad Institute, Inc., "Examination Report No. 1 for Standard Patent Application for AU 2018271372", dated Jun. 5, 2020, 5 pages.

The Broad Institute, Inc., "Examination Report No. 4 for Standard Patent Application for AU 2018271372", dated Jun. 3, 2021, 4 pages.

The Broad Institute, Inc., "International Search Report and Written Opinion issued in International Application No. PCT/US2017/038154", dated Sep. 25, 2017, 1-12.

Abudayyeh, et al., "C2c2 is a Single-Component Programmable RNA-Guided RNA-Targeting CRISPR Effector", Science, vol. 353, No. 6299, 29 pages, Jun. 2, 2016.

East-Seletsky, et al., "Two distinct RNase activities of CRISPR-C2c2 enable guide-RNA processing and RNA detection", Nature, vol. 538. No. 7624, Sep. 26, 2016, 270-273.

Shmakov, et al., "Discovery and functional characterization of diverse class 2 CRISPR-Cas systems", Molecular Cell, vol. 60, No. 3, Nov. 1, 2015, 385-397.

The Broad Institute, Inc., "Examination Report No. 3 for Standard Patent Application for AU 2018271372", dated Mar. 23, 2021, 8 pages.

The Broad Institute, Inc., "Notice of Grounds for Rejection for KR 10-2019-7001527", dated Apr. 29, 2022, 10 pages.

Peng et al., "Potential pitfalls of CRISPR/Cas9-mediated genome editing", FEBS Journal, 283, pp. 1218-1231, 2016.

The Broad Institute, Inc., "Notice of Reasons for Rejection for JP 2018-566199", dated Apr. 5, 2022, 7 pages.

The Broad Institute, Inc., "First Office Action for Chinese Patent Application No. 201780050351.5", dated Aug. 15, 2022, 10 pages.

(56) References Cited

OTHER PUBLICATIONS

The Broad Institute, Inc., "Examination report No. 1 for Standard Patent Application for AU 2021203747", dated Dec. 8, 2022, 5 pages.

* cited by examiner

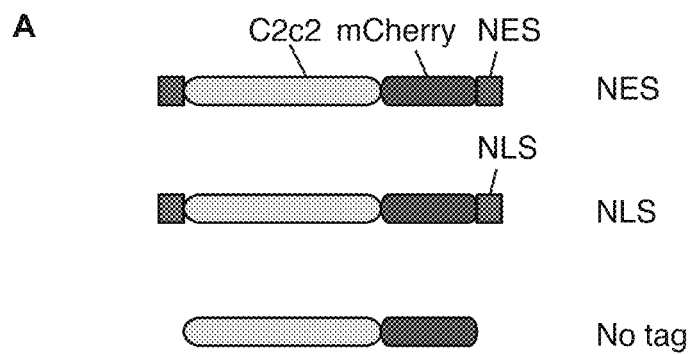
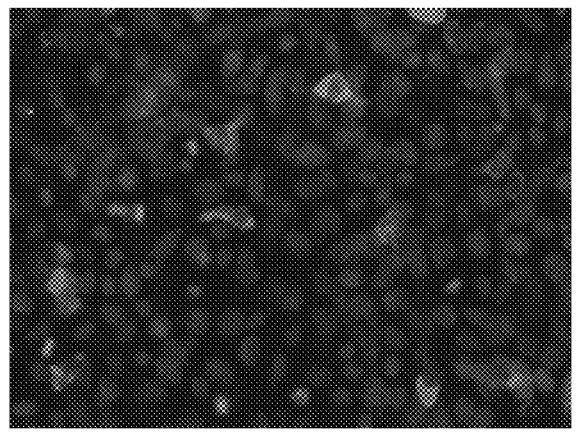
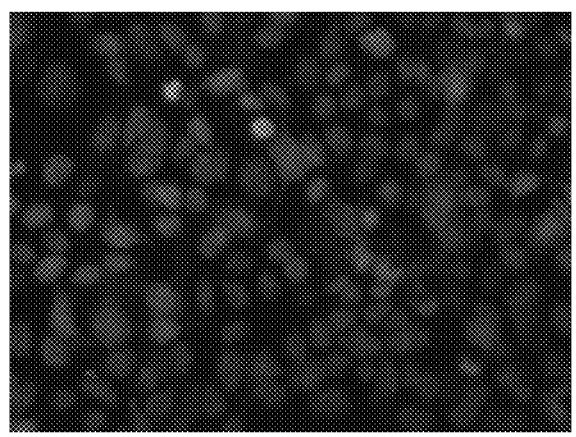
Fig. 1A

C1
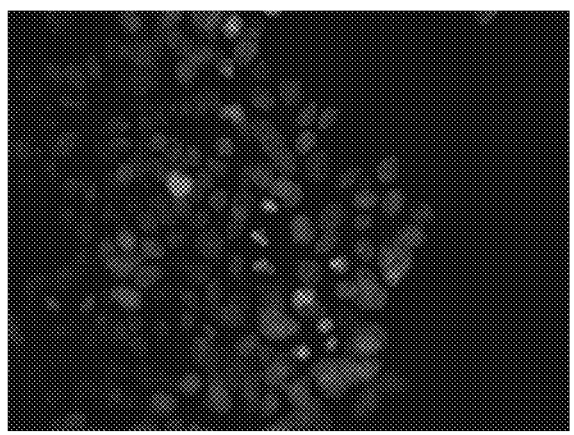
C2
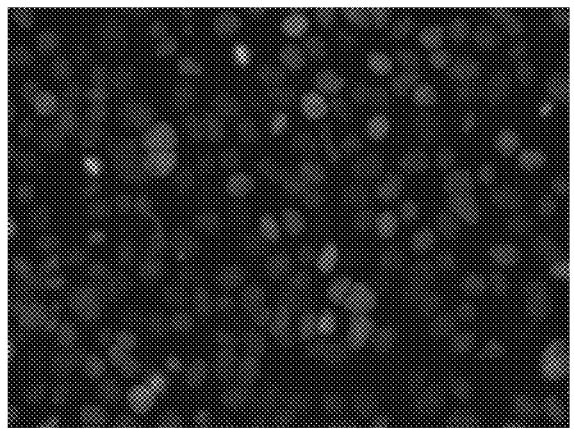
C3
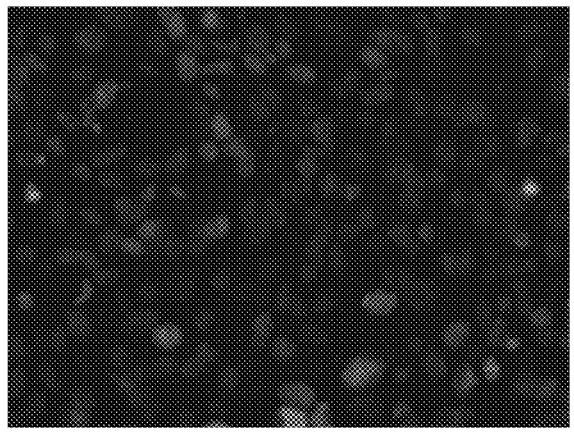
Fig. 1B

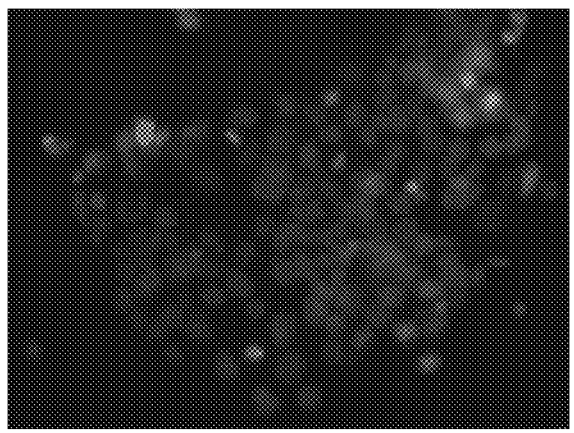
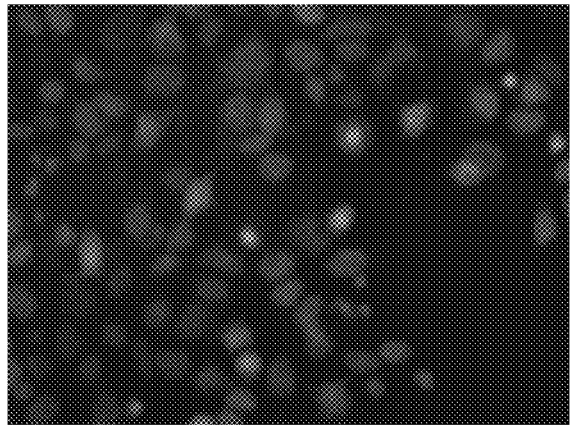
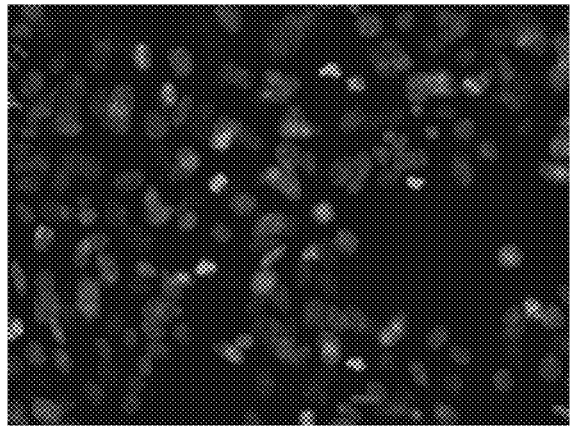
Fig. 1C

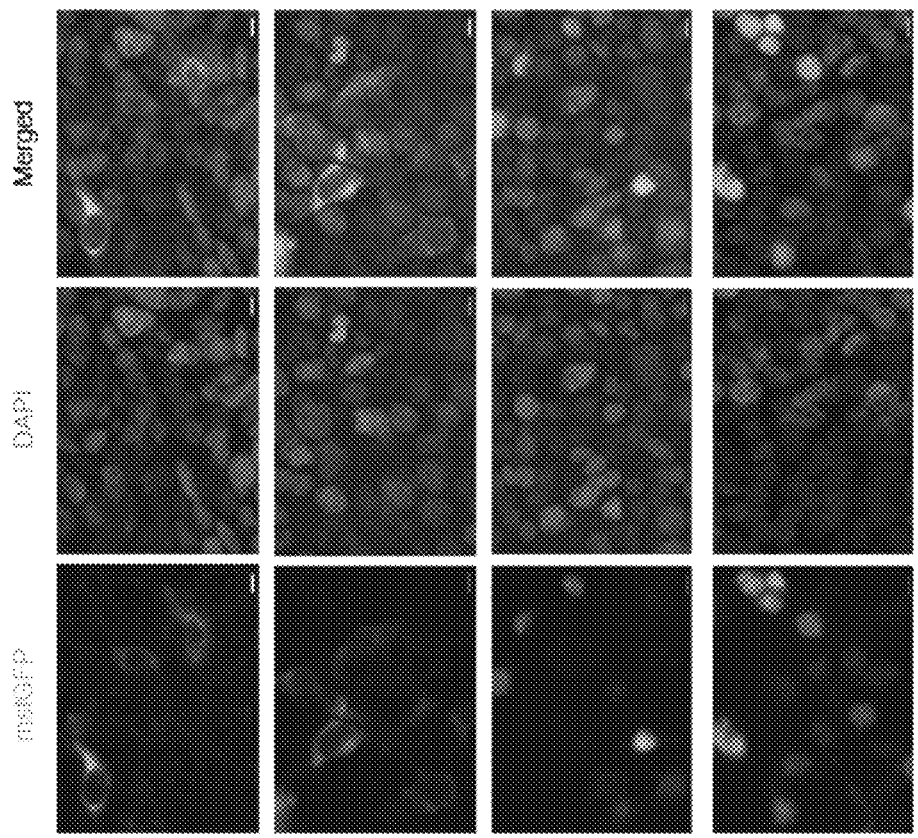
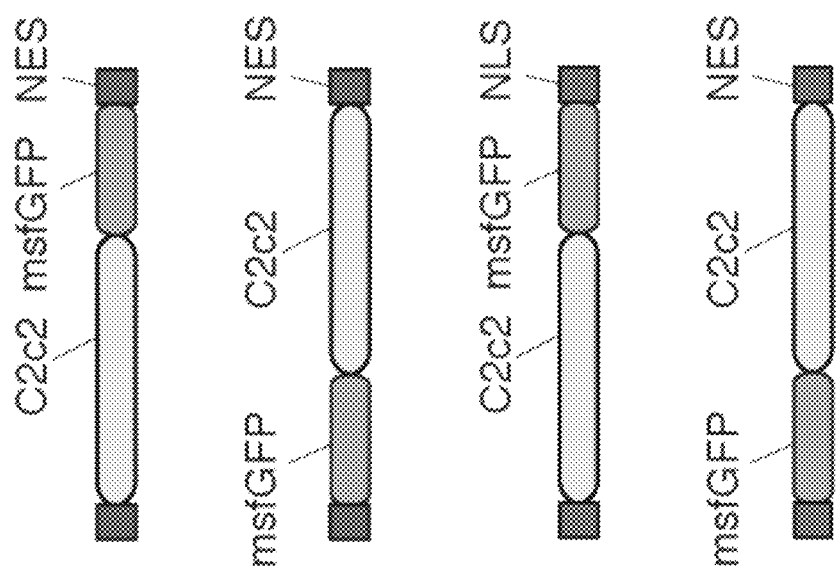
Fig. 1D

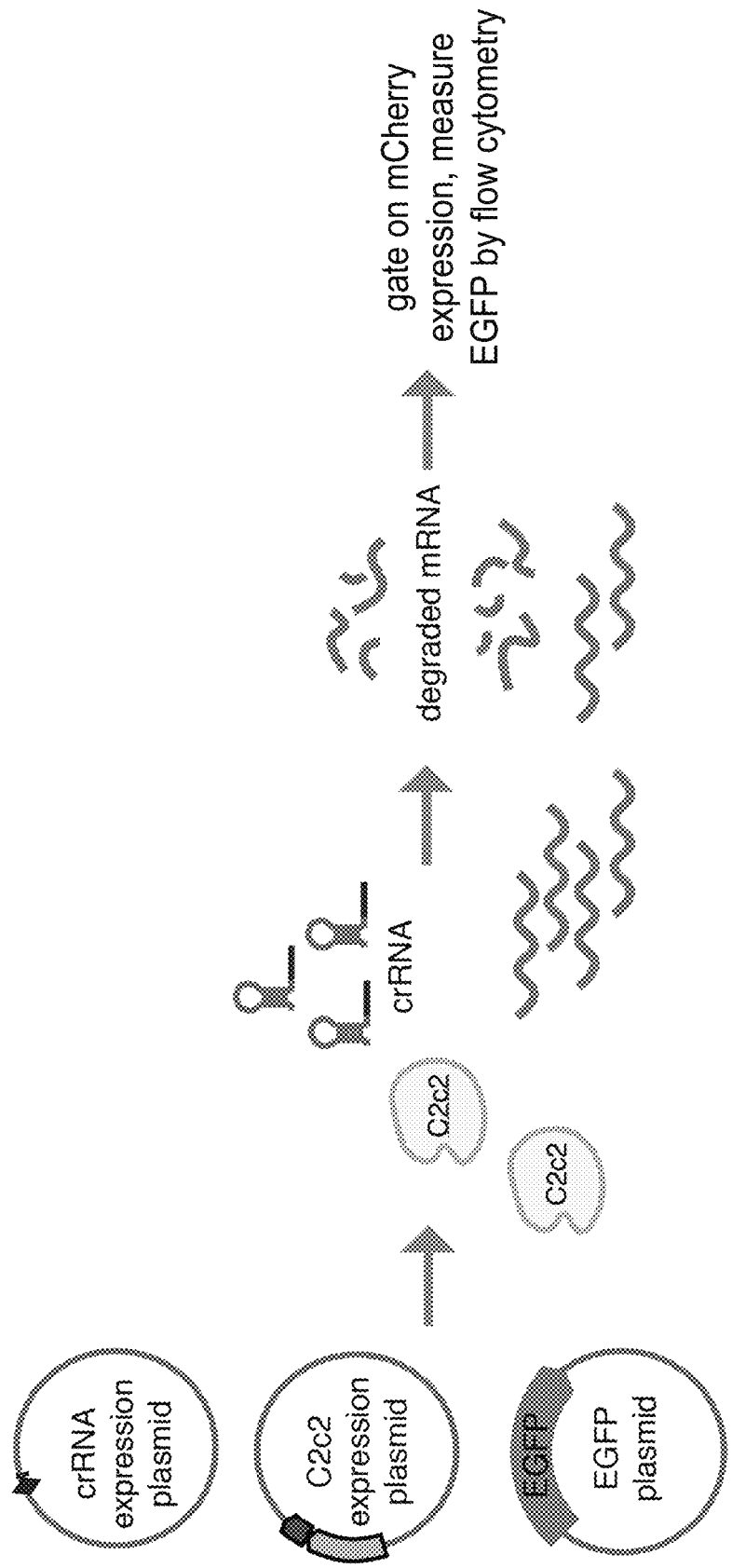

A.
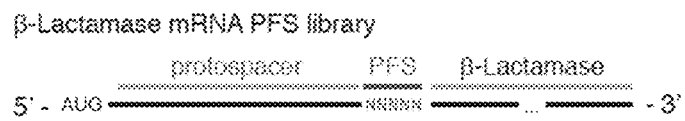
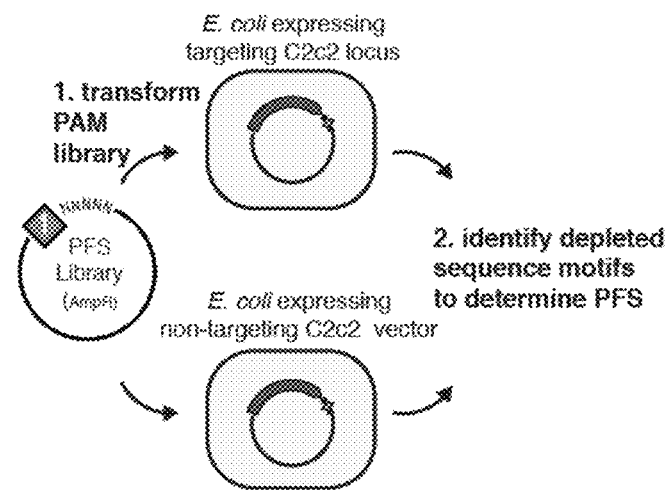
B.
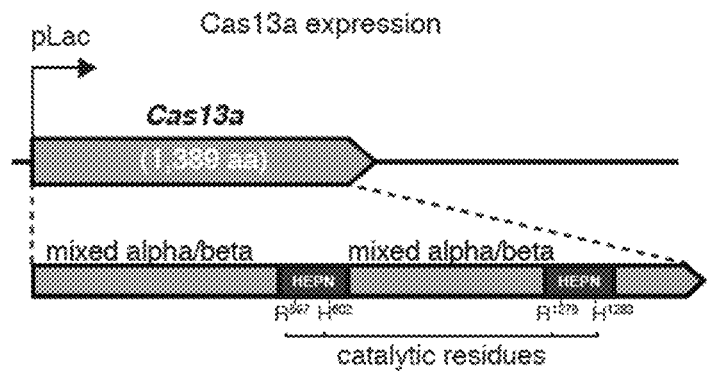
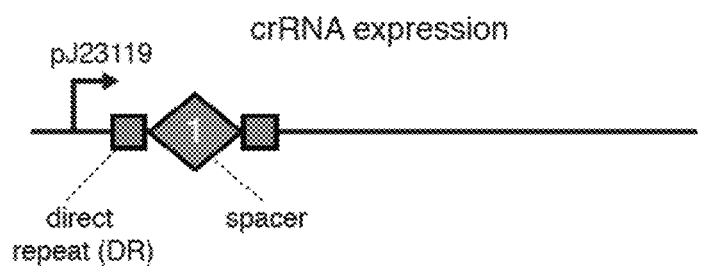
Fig 3A-3B

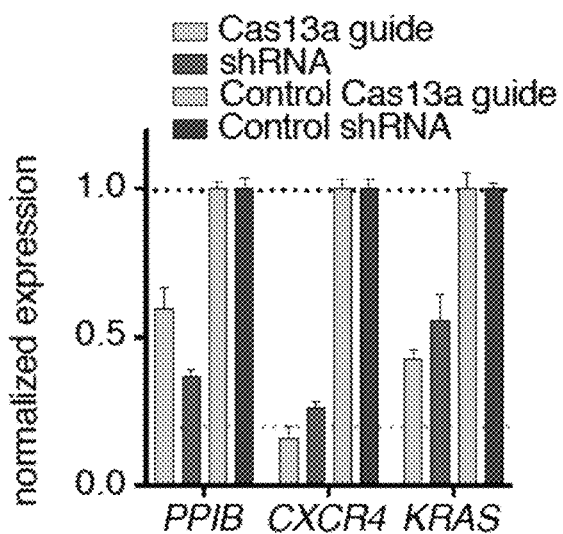
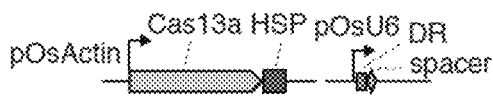
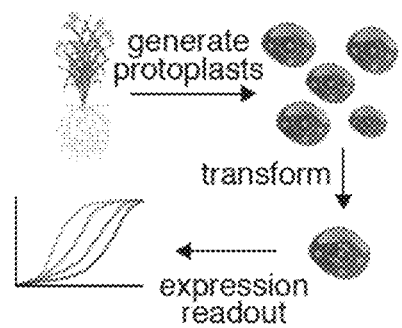
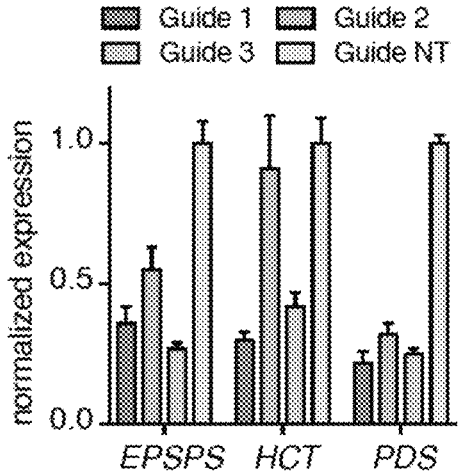
Fig. 3O-3Q

A

B.

A.

B.

A.

B.

C.

D.

A.

B.

A

B

C

A

B

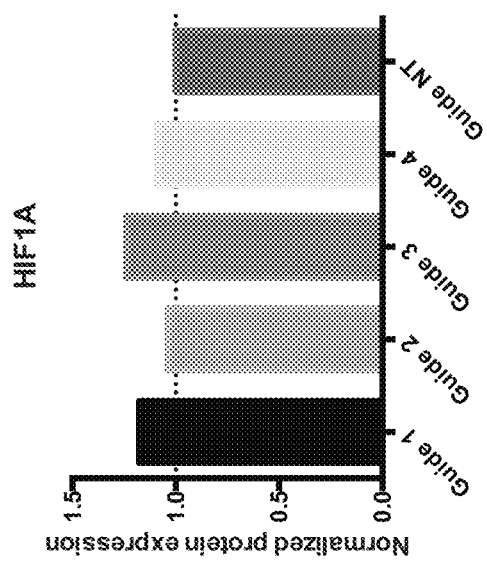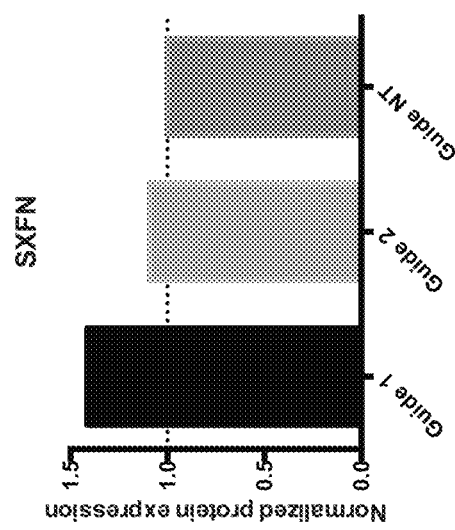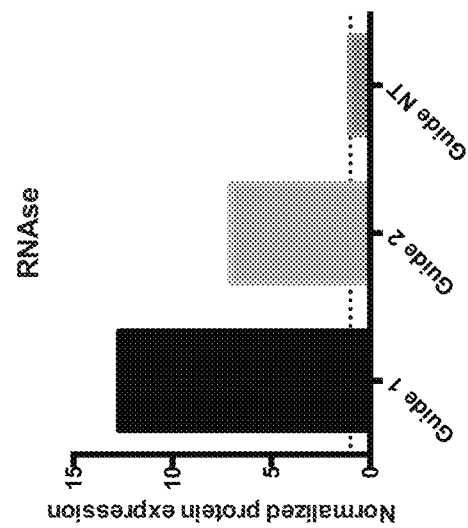
Fig. 18

Lw2 is more specific than shRNA
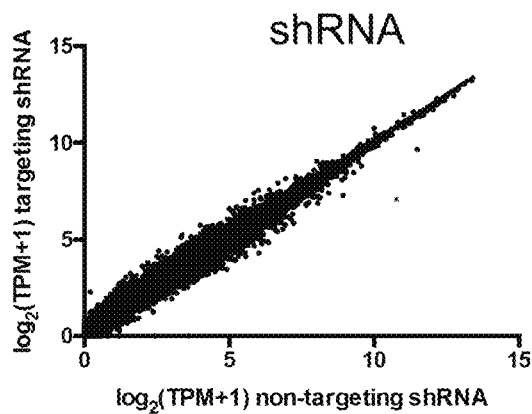
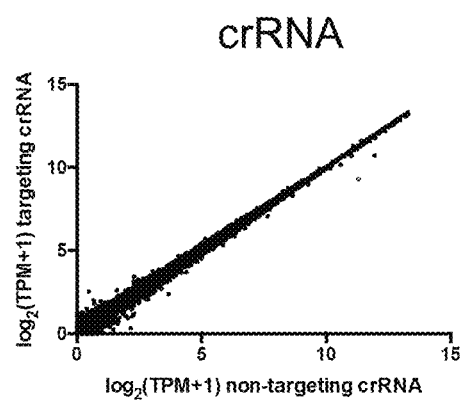
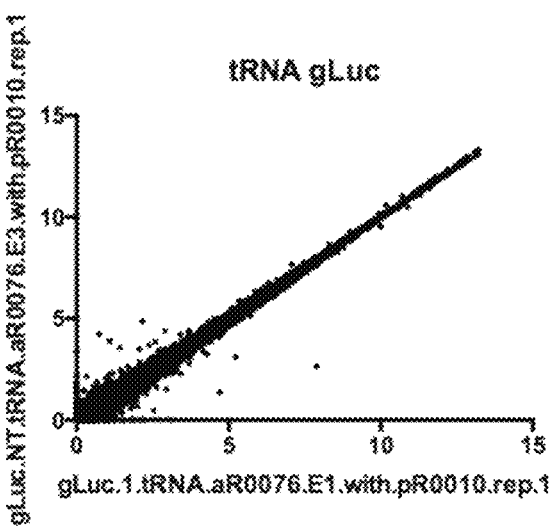
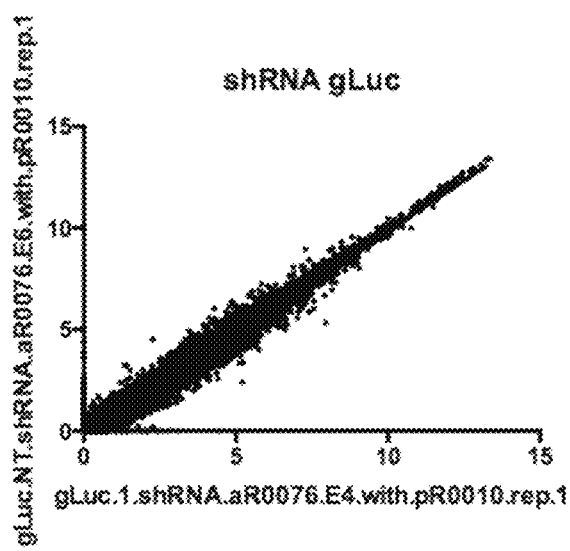
Fig. 19

A

B

```
SEQ ID    Alignment of Lw2C2c2 and LbuC2c2
NOS:      Score = 4419.0; Identities = 937/1168 (80%); Positives 1036/1168 (88%);
          Gaps = 20/1168 (2%)

412       Lw2C2c2   1    MKVTKVDGISHKKYIEEGRLVKSTSEENRTSERLSELLSIRLDIYIKNPDNASEEENRIR     60
                         MKVTKV GISHKKY  EG+LVKS SEENRT ERLS LL++RLD+YIKNP +  +EN+ R
74        LbuC2c2   1    MKVTKVGGISHKKYTSEGRLVKSESEENRTDERLSALLNMRLDMYIKNPSSTETKENQKR     60

Lw2C2c2   61   RENLKKFFSNKVHLKDSVLYLKNRKENAVQDRNYSEEDISEYDLKNKNSFSVLKKILL    120
                          L KKFFSNK+++LKD+ L LKN K++N   D+ YSE DI E D+++K +F+VLKKI L
          LbuC2c2   61   IGKLKKFFSNKMVYLKDNTLSLKNGKKENI--DREYSETDILESDVRDKRNFAVLKKIYL   118

Lw2C2c2   121  NEDVNSEELEIFRKDVEARLNKINSLKYSFEENKANYQKINENNVEKVGGKSKRNIIYDY  180
                         NE+VNSEELE+FR D++ KLNKINSLKYSFE+NKANYQKINENN+EKV GKSKRNIIYDY
          LbuC2c2   119  NENVNSEELEVFRNDIRKKLNKINSLKYSFEKNKANYQKINENNIEKVEGKSKRNIIYDY  178

Lw2C2c2   181  YRESAKRNDYINNVQEAFDKLYKKEDIERLFFLIENSKRHEKYKIREYYHKIIGRKNDKE  240
                         YRESAKR+ Y++NV+EAFDKLYK+EDI KL   IEN K EKYKIRE+YH+IIGRKNDKE
          LbuC2c2   179  YRESAKRDAYVSNVKEAFDKLYKEEDIAKLVLEIENLTKLEKYKIREFYHEIIGRKNDKE  238

Lw2C2c2   241  NFAKIIYEEIQNVTNNIKELIEKIPDMSELKKSQVFYKYYLDKEELNDKNIKYAFCHFVEI  300
                         NFAKIIYEEIQNVTN+KELIEK+PDMSELKKSQVFYKYYLDKEELNDKNIKYAFCHFVEI
          LbuC2c2   239  NFAKIIYEEIQNVTNMRELIEKVPDMSELKKSQVFYKYYLDKEELNDKNIKYAFCHFVEI  298

Lw2C2c2   301  EMSQLLKNYVYKRLSNISNDKIKRIFEYQNLRKLIENKLLNKLDTYVRNCGKYNYYLQVG  360
                         EMSQLLKNYVYKRLSNISNDKIKRIFEYQNLRKLIENKLLNKLDTYVRNCGKYNYYLQ G
          LbuC2c2   299  EMSQLLKNYVYKRLSNISNDKIKRIFEYQNLRKLIENKLLNKLDTYVRNCGKYNYYLQDG  358

Lw2C2c2   361  EIATSDFIARNRQNEAFLRNIIGVSSVAYFSLRNILETENENGITGRMRGKTVRNNKGEE  420
                         EIATSDFIARNRQNEAFLRNI IGVSSVAYFSLRNILETENEN ITGRMRGKTVRNNKGEE
          LbuC2c2   359  EIATSDFIARNRQNEAFLRNIIGVSSVAYFSLRNILETENENDITGRMRGNTVRNNKGEE  418

Lw2C2c2   421  KYVSGEVDKIYNENKQNEVKENLKMFYSYDFNMDNRNEIEDFFANIDEAISSIRHGIVHF  480
                         KYVSGEVDKIYNENK+NEVKENLKMFYSYDFNMDNRNEIEDFFANIDEAISSIRHGIVHF
          LbuC2c2   419  KYVSGEVDKIYNENKRNEVKENLKMFYSYDFNMDNRNEIEDFFANIDEAISSIRHGIVHF  478

Lw2C2c2   481  NLELEGKDIFAFKNIAPSEISKKMFQNEINEKKLKLKIFKQLNSANVFNYYEKDVIIKYL  540
                         NLELEGKDIFAFKNIAPSEISKKMFQNEINEKKLKLKIF+QLNSANVF Y EK I+ YL
          LbuC2c2   479  NLELEGKDIFAFKNIAPSEISKKMFQNEINEKKLKLKIFRQLNSANVFRYLEKYKILNYL  538

Lw2C2c2   541  KNTRFNFVNKNIPFVPSFTKLYNKIEDLRNTLKFFWSVP------KDKEEKDAQIYLLKN  594
                         K T+F FVNKNIPFVPSFTKLY++I+DL+N+L  +W P      K KE DAQIYLLKN
          LbuC2c2   539  KRTRFEFVNKNIPFVPSFTKLYSRIDDLKNSLGIYWKTPKTNDDNKTKEIIDAQIYLLKN  598

Lw2C2c2   595  IYYGEFLNKFVKNSKVFFKITNEVIKINK--QRNQKTGHYKYQRFENIEKTVPVEYLAII  652
                         IYYGEFLN F+ N+  FF+I E+I++NK  +RN KTG YK QRFE+I++ +P EYLA I
          LbuC2c2   599  IYYGEFLNYFMSNNGNFFEISKEIIELNKNDRRNLKTGFYKLQRFEDIQEKIPKEYLANI  658

Lw2C2c2   653  QSREMIN--NQDKEEKNTYIDFIQQIFLRGFIDYL-NKNNLKYIESNNNNDNNDIFSKIK  709
                         QS MIN  NQD+EEK+TYIDFIQ+IFLRGF+ YL N   L I   ++ + N    +
          LbuC2c2   659  QSLYMINAGNQDEEEKDTYIDFIQKIFLKGFMTYLANNGRLGLIYIGSDEETNTSLA---  715

Lw2C2c2   710  IKKDNKEKYDKILKNYEKHNRNKEIPHEINEFVREIKLGKILKYTENLRMFYLILKLLNH  769
                         + K+++DK LK YE++N N +IP+EINEF+REIKLG ILKYTE LRMFYLILKLLNH
          LbuC2c2   716  ---EKKQEFDKFLKKYEQNN-NIKIPYEINEFLREIKLGNILKYTERLRMFYLILKLLNH  771

Lw2C2c2   770  KELTNLRGSLEKYQSANKEETFSDELELINLLNLDNNRVTEDFELEANEIGKFLDFNENK  829
                         KELTNLRGSLEKYQSANKEE FSD+LELINLLNLDNNRVTEDFELEA+EIGKFLDFN NK
          LbuC2c2   772  KELTNLRGSLEKYQSANKEEAFSDQLELINLLNLDNNRVTEDFELEADEIGKFLDFNGNK  831
```

Fig. 28A

```
Lw2C2c2   830   IKDRKELKKFDTNKIYFDGENIIKHRAFYNIKKYGMLNLLEKIADKAKYKISLKELKEYS   889
                +KD KELKKFDTNKIYFDGENIIKHRAFYNIKKYGMLNLLEKIADKA YKIS++ELK+YS
LbuC2c2   832   VKDNKELKKFDTNKIYFDGENIIKHRAFYNIKKYGMLNLLEKIADKAGYKISIEELKKYS   891

Lw2C2c2   890   NKKNEIEKNYTMQQNLHRKYARPKKDEKFNDEDYKEYEKAIGNIQKYTHLKNKVEFNELN   949
                NKKNEIEKN+ MQ+NLHRKYARP+KDEKF DEDY+ Y++AI NI++YTHLKNKVEFNELN
LbuC2c2   892   NKKNEIEKNHKMQENLHRKYARPRKDEKFTDEDYESYKQAIENIEEYTHLKNKVEFNELN   951

Lw2C2c2   950   LLQGLLLKILHRLVGYTSIWERDLRFRLKGEFPENHYIEEIFNFDNSKNVKYKSGQIVEK   1009
                LLQGLLL+ILHRLVGYTSIWERDLRFRLKGEFPEN YIEEIFNF+N KNVKYK GQIVEK
LbuC2c2   952   LLQGLLLRILHRLVGYTSIWERDLRFRLKGEFPENQYIEEIFNFENKKNVKYKGGQIVEK   1011

Lw2C2c2   1010  YINFYRELYKDNVEKRSIYSDKKVKKLQEKKDLYIRNYIAHFNYIPHAEISLLEVLENL   1069
                YI FYKEL++++  K + YS   +K LKQEKKDLYIRNYIAHFNYIPHAEISLLEVLENL
LbuC2c2   1012  YIKFYKELHQNDEVKINKYSSANIKVLKQEKKDLYIRNYIAHFNYIPHAEISLLEVLENL   1071

Lw2C2c2   1070  RKLLSYDRKLKNAIMKSIVDILKEYGFVATFKIGADKKIEIQTLESEKIVHLKNLKKKL   1129
                RKLLSYDRKLKNA+MKS+VDILKEYGFVATFKIGADKKI IQTLESEKIVHLKNLKKKL
LbuC2c2   1072  RKLLSYDRKLKNAVMKSVVDILKEYGFVATFKIGADKKIGIQTLESEKIVHLKNLKKKL   1131

Lw2C2c2   1130  MTDRNSEELCELVKVMFEYKALE-----   1152
                MTDRNSEELC+LVK+MFEYK  E
LbuC2c2   1132  MTDRNSEELCKLVKIMFEYKMEEKKSEN   1154
```

Fig. 28B

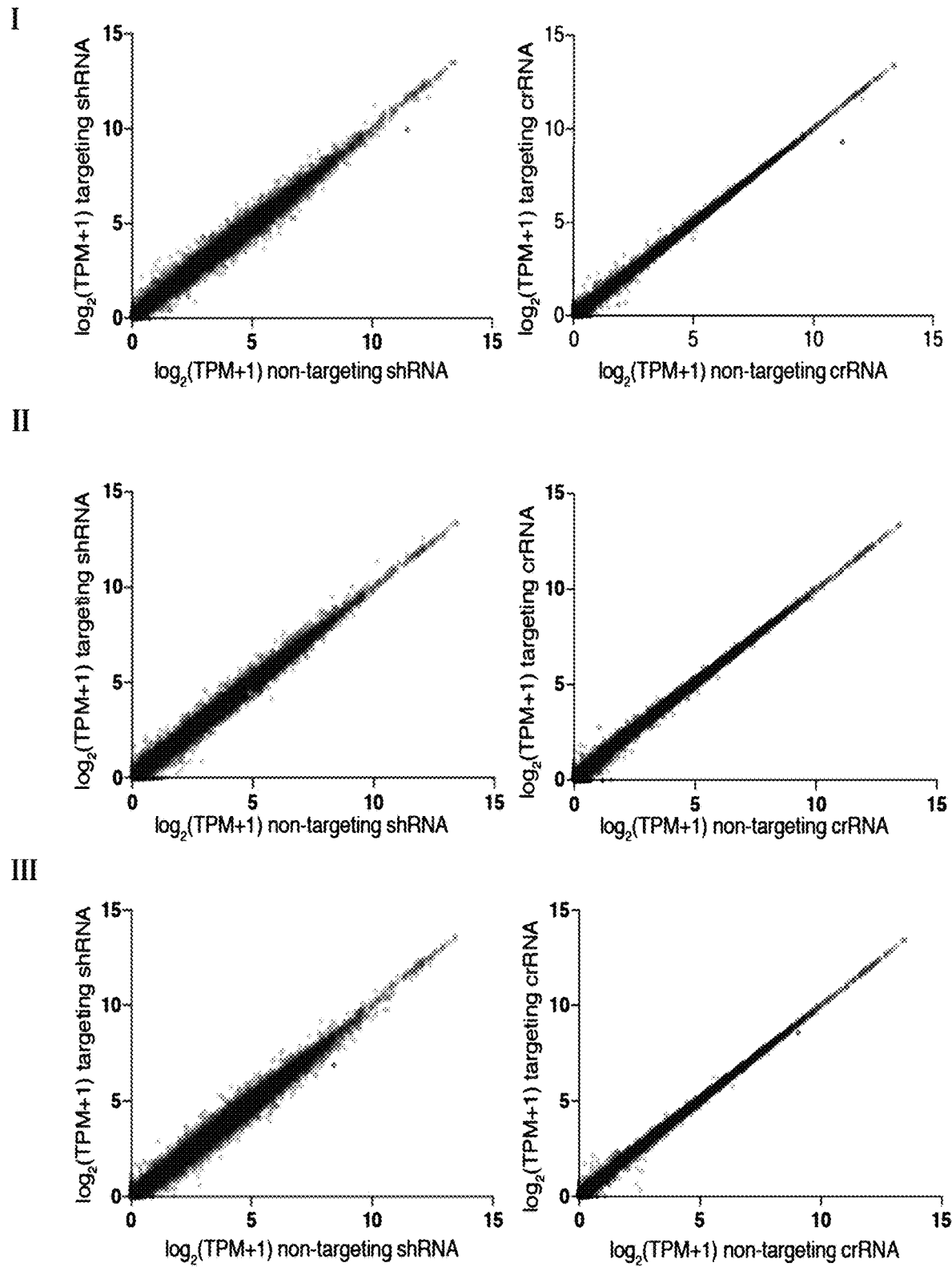
Fig. 29D-I - 29D-III

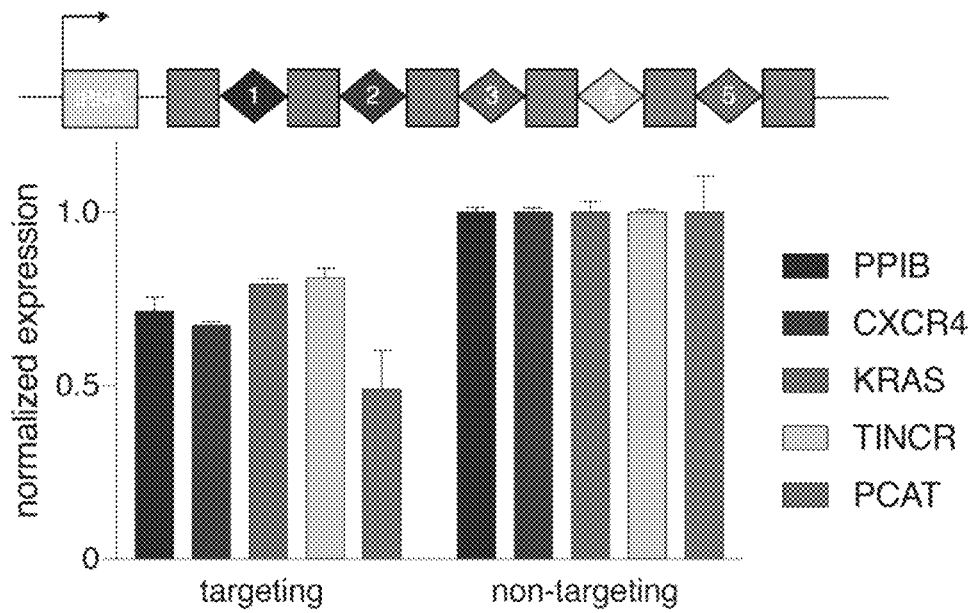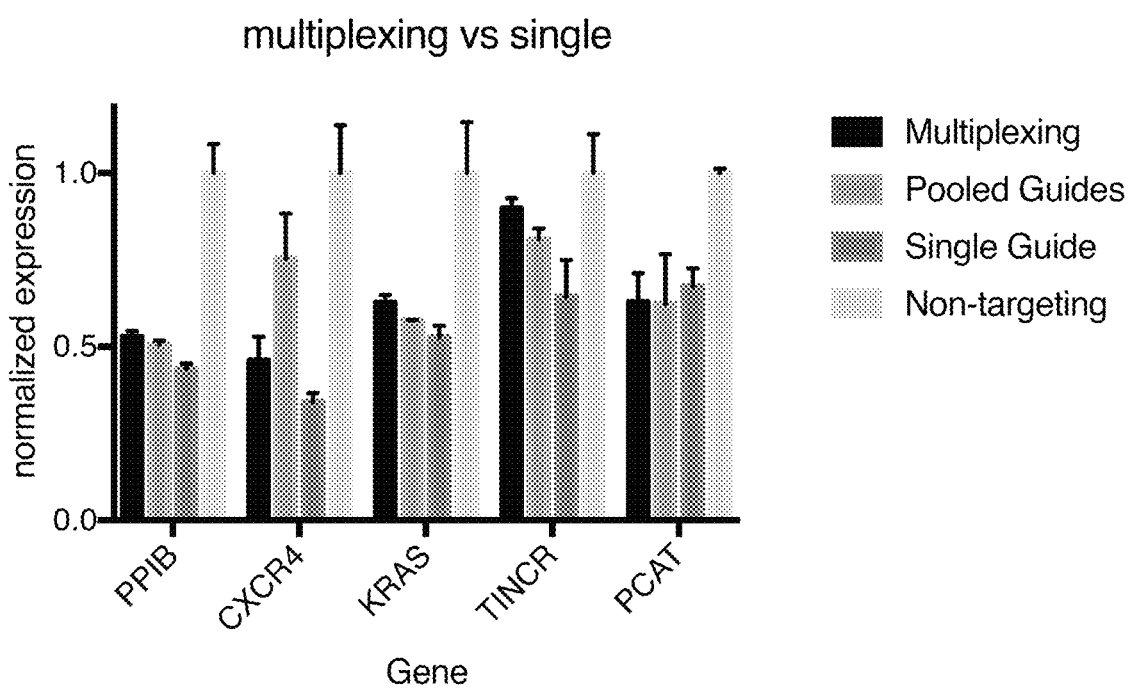
Fig. 31

A

B

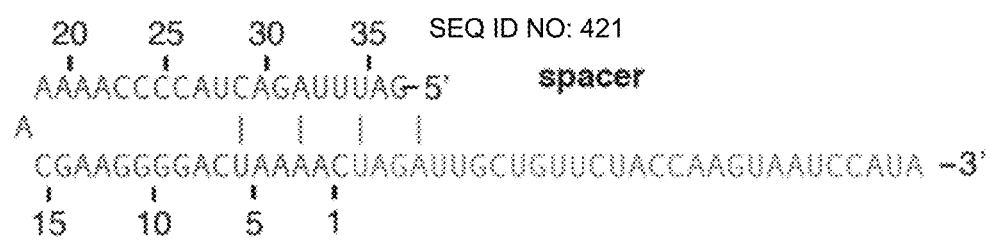
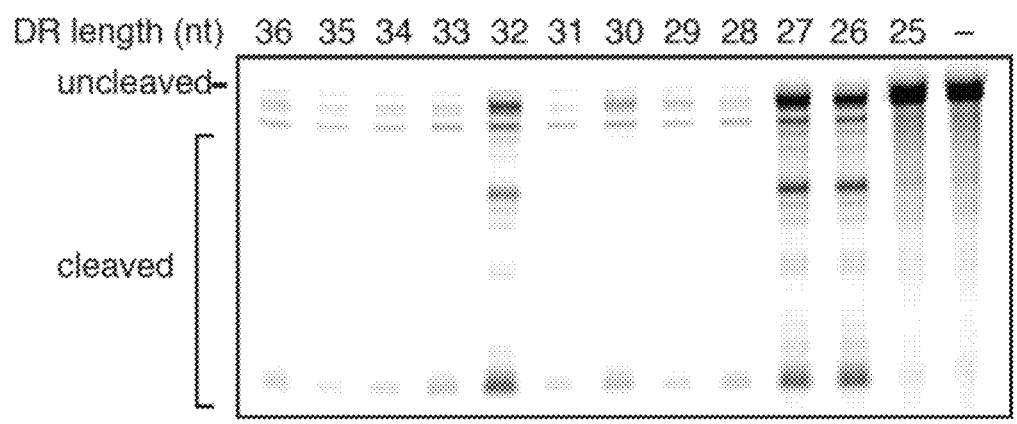
Fig. 40

D.

E.

Stress granules

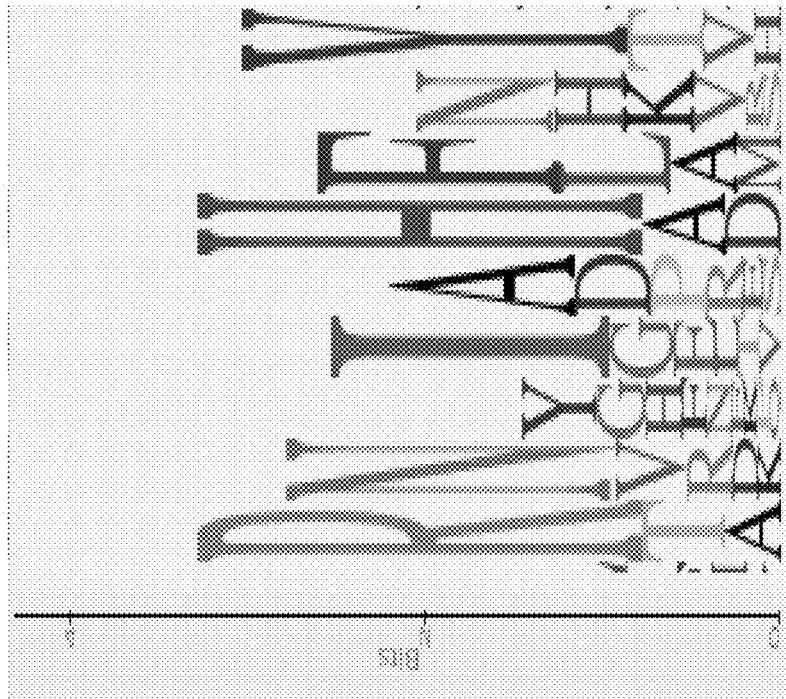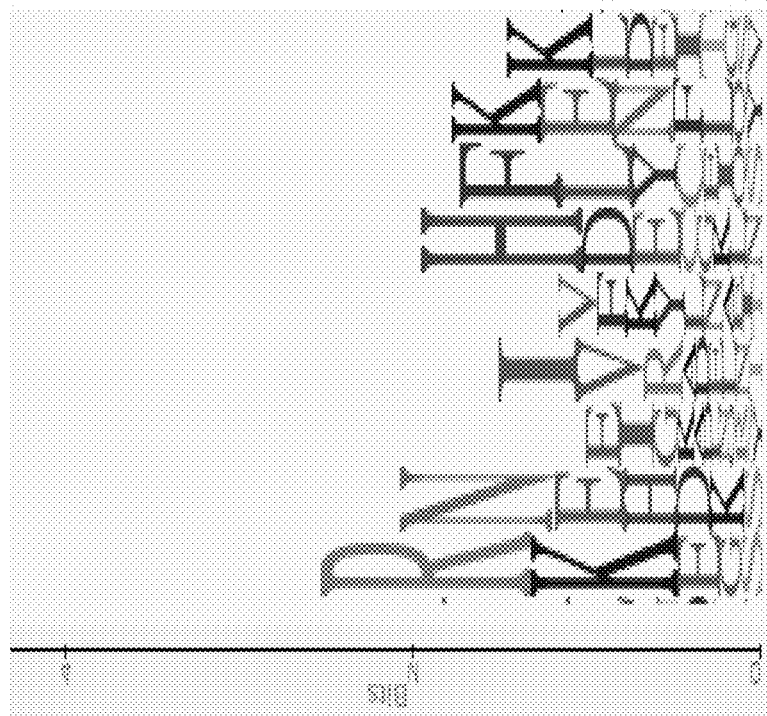
Fig. 50

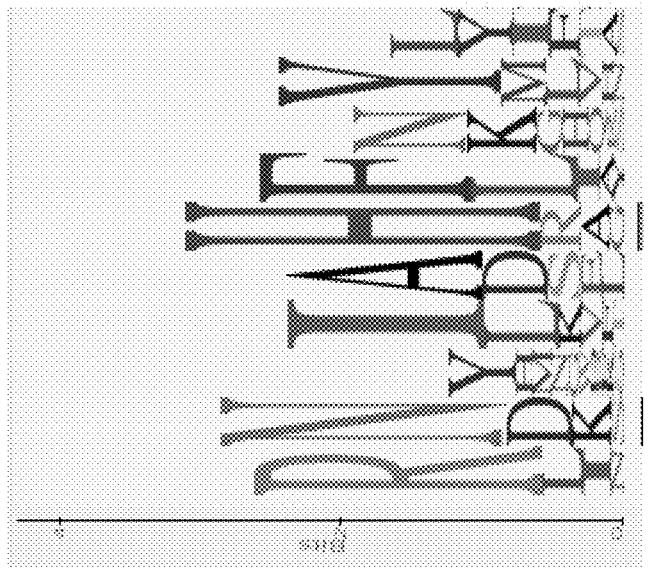
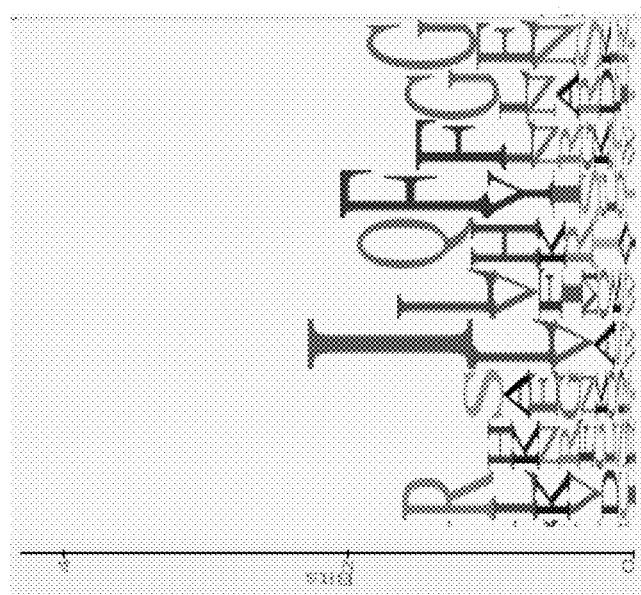
Fig. 51

SEQ ID NOS: 68, 69, 59-61, 80, 62-64, 73, 65, 66, 79, 71, 425 and 67, respectively, in order of appearance

```
                     1         10        20        30        40        50        60
                     |         |         |         |         |         |         |
    15-RcSBC2C2      ------------------------MQIGKVQG-RTISEFGDP--AGGLKRKISTDGKN
     16-RcRC2C2      ------------------------MQIGKVQG-RTISEFGDP--AGGLKRKISTDGKN
   01-Lb(MA)C2C2     ------------------------MQISKVNH-KHV--------AVGQKDRERITGFI
  02-Lb(NK-1)C2C2    ------------------------MKISKVREENRGAKLTVNAKTAVVSENRSQEGIL
       03-CaC2C2     ------------------------MKFSKVDH-TRSA-------VGIQKATDSVHGML
  04-Lb(NK-2)C2C2    ------------------------MKISKVDH-TRMAVA-----KGNQHRRDEISGIL
      05-Cg1C2C2     ------------------------MRITKVKI-KLDNKLY----QVTMQKEEKYGTLK
       06-Cg2C2C2    ------------------------MRMTKVKI-NGS--------PVSMNRSKLNGHLV
       07-PpC2C2     ------------------------MRVSKVKV-KDGGKDK----MVLVHRKTTGAQLV
       08-LsC2C2     MWISIKTLIHHLGVLFFCDYMYNRREKKIIEVKT-MRITKVEVDRKKVLISRDKNGGKLV
       09-LiwC2C2    ------------------------------------------------------------
       10-LibC2C2    ------------------------MKITKMRV-DGR--------TIVMERTSKEGQLG
      13-LspC2c2     ---------------------MGNLFGHKRWYEVRD-KKDFKIKR---KVKVKRNYDGNKYI
       14-LsC2C2     ---------------------MGNLFGHKRWYEVRD-KKDFKIKR---KVKVKRNYDGNKYI
     11-Lew1C2C2     ------------------------MKVTKI--------------DGLSHKKFEDEGKL
     12-Lew2C2C2     ------------------------MKVTKV--------------DGISHKKYIEEGKL 61        70        80        90        100       110       120
                     |         |         |         |         |         |         |
    15-RcSBC2C2      --RKELPAHLSSDPKALIGQWI--------SGIDKIYRKPDSRKS---------------
     16-RcRC2C2      --RKELPAHLSSDPKALIGQWI--------SGIDKIYRKPDSRKS---------------
   01-Lb(MA)C2C2     --YNDPVGDEKSLEDVVAKRANDT------KVLFNVFNTKDLYDSQE-------------
  02-Lb(NK-1)C2C2    --YNDPSRYGKSRKNDEDRDRYIESRLKSSGKLYRIFNEDKNKRETDELQWFLSEIVKKI
       03-CaC2C2     --YTD-PKKQEVNDLDKRFDQLNVKA----KRLYNVFNQSKAEEDDDE------------
  04-Lb(NK-2)C2C2    --YKD-PTKTGSIDFDERFKKLNCSA----KILYHVFNGIAEGSNKYK------------
      05-Cg1C2C2     --LNE--ESRKSTAEILRLKKASFNK----SFHSKTINSQKENKNATI------------
       06-Cg2C2C2    ------WNGTTNTVNILTKKEQSFAA----SFLNKTLVKADQVKGYKVL-----------
       07-PpC2C2     --YSGQPVSNETSNILPEKKRQSFDL----STLNKTIIKFDTAKKQKL------------
       08-LsC2C2     --YEN--EMQDNTEQIMHHKKSSFYK----SVVNKTICRPEQKQMKK-------------
       09-LiwC2C2    ------------------------------------------------------------
       10-LibC2C2    --YEG-IDGNKTTEIIFDKKKESFYK----SILNKTVRKPDEKEKNRR------------
      13-LspC2c2     LNINENNNKEKIDNNKFIGEFVNY------KKNNNVLKEFKRKFHAGN------------
       14-LsC2C2     LNINENNNKEKIDNNKFIRKYINY------KKNDNILKEFTRKFHAGN------------
     11-Lew1C2C2     VKFRNNKNINEIKERLKKLKE---------LKLDNYIKNPENVKNKDK------------
     12-Lew2C2C2     --VKSTSEENRTSERLSELLS---------IRLDIYIKNPDNAS----------------

121       130       140       150       160       170       180
                     |         |         |         |         |         |         |
    15-RcSBC2C2      ------------------------------------DGKAIHSPTPSKMQFDARD----
     16-RcRC2C2      ------------------------------------DGKAIHSPTPSKMQFDARD----
   01-Lb(MA)C2C2     ---------------SDKSEKDKEIISKGAKFVAKSFNSAITILKKQNKIYSTLTS----
  02-Lb(NK-1)C2C2    NRRNGLVLSDMLSVDDRAFEKAFEKYAELSYTNRRNKVSGSPAFETCGVDAATAERLKGI
       03-CaC2C2     ---------------KRFGKVVKKLNRELKDLLFHREVSRYNSIGNAKYNYYGIKSNP--
  04-Lb(NK-2)C2C2    ---------------NIVDKVNNN------------LDRVLFTGKSYDRKSIIDI-----
      05-Cg1C2C2     ---------------KKNGDYISQIFEKLVG------VDTNKNIRKPKMSLTDLKDLPK-
       06-Cg2C2C2    ---------------AENIFIIFE------------QLEKSNSEKPSVYLNNIRRLKE-
       07-PpC2C2     ---------------NVDQYKIVEK-----------IFKYPKQELPKQIKA--------
       08-LsC2C2     ------------------------------------LVHGLLQENSQEKIKVSDVTK--
       09-LiwC2C2    ------------------------------------MLALLHQEVPSQKLHNLKSLNT-
       10-LibC2C2    ---------------KQAINKAINKEITEL------MLAVLHQEVPSQKLHNLKSLNT-
      13-LspC2c2     ------------------------------------ILFKLKGKEEIIRIENNDDFLET
       14-LsC2C2     ------------------------------------ILFKLKGKEGIIRIENNDDFLET
     11-Lew1C2C2     ---------------DAEKETKIRRTNLKKYF-----SEIILRKEDEKYILKKTKKFKDI
     12-Lew2C2C2     ------------------------------------EEENRIRRENLKKFFSNKVLHL-
```

FIG. 53A

```
                    181       190       200       210       220       230       240
                     |         |         |         |         |         |         |
      15-RcSBC2C2   DLGEAFWKLVSEAGLAQ----DSDYDQFKRRLHPYGDKFQPADSGAKLKFEAD-------
      16-RcRC2C2    DLGEAFWKLVSEAGLAQ----DSDYDQFKRRLHPYGDKFQPADSGAKLKFEAD-------
      01-Lb(MA)C2C2 QQVIKELKDKFGGARIY------DDDIEEALTETLKKSFRKENVRNSIKVLIENAAGIRS
      02-Lb(NK-1)C2C2 ISETNFINRIKNNIDNK------VSEDIIDRIIAKYLKKSLCRERVKRGLKKLLMNAFDLPY
      03-CaC2C2     EEIVSNLGMVESLKGER----DPQKVISKLLLYYLRKGLKPGTDGLRMILEASCGLRKLS
      04-Lb(NK-2)C2C2 DTVLRNVEKINAFDRISTE--EREQIIDDLLEIQLRKGLRKGKAGLREVLLIGAGVIVRT
      05-Cg1C2C2    KDLALFIKRKFK-----------NDDIVEIKNLDLISLFYNALQKVPGEHFTDESWADFC
      06-Cg2C2C2    AGLKRFFKSKYHEEIKY----TSEKNQSVPTKLNLIPLFFNAVDRIQEDKFDEKNWSYFC
      07-PpC2C2     EEILPFLNHKFQEPVKYW---KNGKEESFNLTLLIVEAVQAQDKR---------------
      08-LsC2C2     LNISNFLNHRFKKSLYYFPENSPDKSEEYRIEINLSQLLEDSLKKQQGTFIC---WESFS
      09-LiwC2C2    ESLTKLFKPKFQNMISY----PPSKGAE-HVQFCLTDIAVPAIRDLDE---IKPDWGIFF
      10-LibC2C2    ESLTKLFKPKFQNMISY----PPSKGAE-HVQFCLTDIAVPAIRDLDE---IKPDWGIFF
      13-LspC2c2    EEVVLYIEVYGKSEKLK----ALEITKKKIIDEAIRQGITKDDKKIEIKRQEN-------
      14-LsC2C2     EEVVLYIEAYGKSEKLK----ALGITKKKIIDEAIRQGITKDDKKIEIKRQEN-------
      11-Lew1C2C2   NQEIDYYDVKSK---------KNQQEIFDVLKEILELKIKETEKEEIITFDSE-------
      12-Lew2C2C2   KDSVLYLKNRKEKNAVQ----DKNYSEEDISEYDLKN--KNSFSVLKKILLNEDV-----

241       250       260       270       280       290       300
                     |         |         |         |         |         |         |
      15-RcSBC2C2   ---PPEPQA---FHGRWYGAMSKRGNDAKELAAALYEHLHVDEKR----I--DG------
      16-RcRC2C2    ---PPEPQA---FHGRWYGAMSKRGNDAKELAAALYEHLHVDEKR----I--DG------
      01-Lb(MA)C2C2 SLSKDEEELIQEYFVKQLVEEYTKTKLQKNVVKSIKNQNMVIQPDSDSQVLSLSESRREK
      02-Lb(NK-1)C2C2 SDPDIDVQR----DFIDYVLEDFYHVRAKSQVSRSIKNMNMPVQPE----G--DGKFAITV
      03-CaC2C2     G--DEKELK---VFLQTLDEDFEKKTFKKNLIRSIENQNMAVQPS----N--EGDPIIGI
      04-Lb(NK-2)C2C2 D--KKQEIA---DFLEILDEDFNKTNQAKNIKLSIENQGLVVSPV----S--RGEERIFD
      05-Cg1C2C2    Q--EMMPYR---EYKNKFIE-----RKIILLANSIEQNKGFSINP---------------
      06-Cg2C2C2    K--EMSPYL---DYKKSYLN-----RKKEILANSIQQNRGFSMPT----A--EEPNL---
      07-PpC2C2     ---KLQPYY---DWKTWYIQ-----TKSDLLKKSIENNRIDLTEN---------------
      08-LsC2C2     K--DMELYI---NWAENYIS-----SKTKLIKKSIRNNRIQST-----------------
      09-LiwC2C2    E--KLKPYT---DWAESYIH------YKQTTIQKSIEQNKIQSP----------------
      10-LibC2C2    E--KLKPYT---DWAESYIH------YKQTTIQKSIEQNKIQSP----------------
      13-LspC2c2    ---EEEIEI---DIRDEYTN--KTLNDCSIILRIIENDELETKKS-----IYEIFKNINMS
      14-LsC2C2     ---EEEIEI---DIRDEYTN--KTLNDCSIILRIIENDELETKKS-----IYEIFKNINMS
      11-Lew1C2C2   ---KLKK-----VFGEDFVK---KEAKIKAIEKSLKINKANYKKD----SIKIGDDKYSN
      12-Lew2C2C2   ---NSEELE---IFRKDVEA---KLNKINSLKYSFEENKANYQKI----N--ENNVEKVG 301       310       320       330       340       350       360
                     |         |         |         |         |         |         |
      15-RcSBC2C2   -----------QPKRNPKTDKFAPGLVV-----ARALGI--ESSVLPRGMARLA---RNW
      16-RcRC2C2    -----------QPKRNPKTDKFAPGLVV-----ARALGI--ESSVLPRGMARLA---RNW
      01-Lb(MA)C2C2 QSSAVSSDTLVNCKEKDVLKAFLTDYAV----LDEDERN-----------SLLW----KLR
      02-Lb(NK-1)C2C2 SKGGTESGNK-RSAEKEAFKKFLSDYAS----LDERVRD-----------DMLR----RMR
      03-CaC2C2     TQGRFNSQ---KNEEKSAIERMMSMYAD----LNEDHRE-----------DVLR----KLR
      04-Lb(NK-2)C2C2 VSGAQKGKSSKKAQEKEALSAFLLDYAD----LDKNVRF-----------EYLR----KIR
      05-Cg1C2C2    ----------ETFSKRKRVLHQWAIEVQE-----RGDFSI-----------LDEKLSKLA---EIY
      06-Cg2C2C2    ----------LSKRKQLFQQWAMKFQESPLIQQNNFAVEQFNKEFANKINELA---AVY
      07-PpC2C2     ----------LSKRKKALLAWETEFTA------SGSIDL-----------THYH----KVY
      08-LsC2C2     ----------ESRSGQLMDRYMKDILN----KNKPFDI-----------QSVS----EKY
      09-LiwC2C2    ----------DSPRKLVLQKYVTAFLN-----GEPLGL-----------DLVA----KKY
      10-LibC2C2    ----------DSPRKLVLQKYVTAFLN-----GEPLGL-----------DLVA----KKY
      13-LspC2c2    LYKIIEKIIE-NETEKVFENRYYEEHLREKLLKDNKIDV--ILTNFMEIREKIKSNLEIM
      14-LsC2C2     LYKIIEKIIE-NETEKVFENRYYEEHLREKLLKDDKIDV--ILTNFMEIREKIKSNLEIL
      11-Lew1C2C2   VKG--------ENKRSRIYEYYKK---------SENLKK--FEENIREAFEKLY---TEE
      12-Lew2C2C2   G----------KSKRNIIYDYYRESAKR------NDYINN-------VQEAFDKLY---KKE
```

FIG. 53B

```
                       361       370       380       390       400       410       420
                        |         |         |         |         |         |         |
       15-RcSBC2C2   GEEEIQTYFVVDVAASVKEVAKAAVSAAQAFDPPR---QVSGRSLSPKVG----------
        16-RcRC2C2   GEEEIQTYFVVDVAASVKEVAKAAVSAAQAFDPPR---QVSGRSLSPKVG----------
     01-Lb(MA)C2C2   NLVNLYFYGSESIRD-------------YSYTKEK---SVWKEHDEQKANKTLFIDEICH
   02-Lb(NK-1)C2C2   RLVVLYFYGSDDSKL-------------SDVNEKF---DVWEDHAARRVDNREFIKLPLE
          03-CaC2C2   RLNVLYFNVDTEKTEEPTLPGE------VDTNPVF---EVWHDHEKGKENDRQF-ATFAK
   04-Lb(NK-2)C2C2   RLINLYFYVKNDDVMSLTEIPAE-----VNLEKDF---DIWRDHEQRKEENGDF-VGCPD
         05-Cg1C2C2   NFKKMCKRVQDELNDLE-----------KSMKKGK---NPEKEKEAYKKQKNF-------
         06-Cg2C2C2   NVDELCTAITEKL---------------MNFDKDK---SNKTRNF--------------
          07-PpC2C2   MTDVLCKMLQDV----------------KPLTDDK---GKINTNAYHRGLK---------
          08-LsC2C2   QLEKLTSALK------------------ATFKEAK---KNDK------------------
         09-LiwC2C2   KLADLAESFKV-----------------VDLNEDK-------------------------
         10-LibC2C2   KLADLAESFKL-----------------VDLNEDK-------------------------
         13-LspC2c2   GFVKFYLNVSGDKKKSEN----------KKMFVEK---ILNTNVDLTVEDIVDFIVKELK
         14-LsC2C2    GFVKFYLNVGGDKKKSKN----------KKMLVEK---ILNINVDLTVEDIADFVIKELE
        11-Lew1C2C2   NIKELYSKIEEILKKTHL----------KSIVREFYQNEIIGESEFSKKNGDGISILYNQ
        12-Lew2C2C2   DIEKLFFLIENSKK--------------HEKYKIR---EYYHKIIGRKNDKENFAKIIYE 421       430       440       450       460       470       480
                        |         |         |         |         |         |         |
       15-RcSBC2C2   --------------------FALAEHLERVTGSKRCSFD--PAAGPSVLAL-----HDE
        16-RcRC2C2   --------------------FALAEHLERVTGSKRCSFD--PAAGPSVLAL-----HDE
     01-Lb(MA)C2C2   ITKIGKNGKEQKVLDYE----ENRSRCRKQNINYYRSALN---YAKNNTSGIFE---NED
   02-Lb(NK-1)C2C2   NKLANGKTDKDAERIRKN---TVKELYRNQNIGCYRQAVK--AVEEDNNGRYFD---DKM
          03-CaC2C2   ILTEDRETRKKEKLAVKEALNDLKSAIRDHNIMAYRCSIK--VTEQDKDGLFFE---DQR
   04-Lb(NK-2)C2C2   ILLADRDVKKSNSKQVKIAERQLRESIREKNIKRYRFSIK--TIEKDDGTYFFA---NKQ
         05-Cg1C2C2   --------------------KIKTIWKDYPYKTHIGLIE--KIKENEELNQF----NIE
         06-Cg2C2C2   --------------------EIKKLWKQHPHNKDKALIKLFNQEGNEALNQF----NIE
          07-PpC2C2   --------------------KALQNHQPAIFGTREVPNE--ANRADNQLSIY----HLE
          08-LsC2C2   --------------------EINYKLKSTLQNHERQIIE--ELKENSELNQF----NIE
         09-LiwC2C2   --------------------SANYKIKACLQQHQRNILD--ELKEDPELNQY----GIE
         10-LibC2C2   --------------------SANYKIKACLQQHQRNILD--ELKEDPELNQY----GIE
         13-LspC2c2   FWNITKRIEKVKKFNN-----EFLENRRNRTYIKSYVLLD--KHEKFKIERENK---KDK
         14-LsC2C2    FWNITKRIEKVKKVNN-----EFLEKRRNRTYIKSYVLLD--KHEKFKIERENK---KDK
        11-Lew1C2C2   IKDSIKKEENFIEFIENTGNLELKELTKSQIFYKYFLENE--ELNDENIKFAFCYFVEIE
        12-Lew2C2C2   EIQNVNNIKELIEKIP-----DMSELKKSQVFYKYYLDKE--ELNDKNIKYAFCHFVEIE 481       490       500       510       520       530       540
                        |         |         |         |         |         |         |
       15-RcSBC2C2   VKKTYKRLCA-------RGKNAARAFPADKTELLALMRHTHEN-RVRNQMVRMGRVSEYR
        16-RcRC2C2   VKKTYKRLCA-------RGKNAARAFPADKTELLALMRHTHEN-RVRNQMVRMGRVSEYR
     01-Lb(MA)C2C2   SNHFWIHLIENEVERLYNGIENGEEFKFETGYISEKVWKAVIN-HLSIKYIALGKAVYN-
   02-Lb(NK-1)C2C2   LNMFFIHRIEYGVEKIYANLKQVTEFKARTGYLSEKIWKDLIN-YISIKYIAMGKAVYN-
          03-CaC2C2   INRFWIHHIESAVERILASINPEKLYKLRIGYLGEKVWKDLLN-YLSIKYIAVGKAVFH-
   04-Lb(NK-2)C2C2   ISVFWIHRIENAVERILGSINDKKLYRLRLGYLGEKVWKDILN-FLSIKYIAVGKAVFN-
         05-Cg1C2C2   IGKYFEHYFP--IKK--ERCTEDEPYYLNSETIATTVNYQLKN-ALISYLMQIGKYKQF-
         06-Cg2C2C2   LGKYFEHYFP-----KTGKKESAESYYLNPQTIIKTVGYQLRN-AFVQYLLQVGKLHQY-
          07-PpC2C2   VVKYLEHYFPIKTSKR-RNTADDIAHYLKAQTLKTTIEKQLVN-AIRANIIQQGKTNHH-
          08-LsC2C2   IRKHLETYFP--IKKTNRKVGDIRN--LEIGEIQKIVNHRLKN-KIVQRILQEGKLASY-
         09-LiwC2C2   VKKYIQRYFP--IKRAPNRSKHARADFLKKELIESTVEQQFKN-AVYHYVLEQGKMEAY-
         10-LibC2C2   VKKYIQRYFP--IKRAPNRSKHARADFLKKELIESTVEQQFKN-AVYHYVLEQGKMEAY-
         13-LspC2c2   IVKFFVENIK---NNSIKEKIEKILAEFKINELIKKLEKELKKGNCDTEIFGIFKKHYKV
         14-LsC2C2    IVKFFVENIK---NNSIKEKIEKILAEFKIDELIKKLEKELKKGNCDTEIFGIFKKHYKV
        11-Lew1C2C2   VNNLLKENVY-KIKRFNESNKKRIENIFEYGKLKKLIVYKLEN-KLNNYVRNCGKYNYH-
        12-Lew2C2C2   MSQLLKNYVY---KRLSNISNDKIKRIFEYQNLKKLIENKLLN-KLDTYVRNCGKYNYY-
```

FIG. 53C

```
              541       550       560       570       580       590       600
                |         |         |         |         |         |         |
 15-RcSBC2C2  GQQAGDLAQSHYWTSAGQTEIKESEIFVRLWVGAFALAGRSMK--AWIDPMGKIVNTEKN
  16-RcRC2C2  GQQAGDLAQSHYWTSAGQTEIKESEIFVRLWVGAFALAGRSMK--AWIDPMGKIVNTEKN
01-Lb(MA)C2C2 -YAMKELSSPG-----DIEPGKIDDSYI---NGITSFDYEIIKAEESLQRDISMNVVFAT
02-Lb(NK-1)C2C2 -YAMDELNASD---KKEIELGKISEEYL---SGISSFDYELIKAEEMLQRETAVYVAFAA
    03-CaC2C2 -FAMEDLGKTG----QDIELGKLSNSVS---GGLTSFDYEQIRADETLQRQLSVEVAFAA
04-Lb(NK-2)C2C2 -FAMDDLQEKD----RDIEPGKISENAV---NGLTSFDYEQIKADEMLQREVAVNVAFAA
   05-Cg1C2C2 -GLENQVLDSK-----KLQEIGIYEGFQTKFMDACVFATSSLK--NIIEPMRSGDILGKR
   06-Cg2C2C2 ---NKGVLDSQ-----TLQEIGMYEGFQTKFMDACVFASSSLK--NIIQATTNEDILTRE
    07-PpC2C2 --ELKADTTSN-----DLIRIKTNEAFVLNLTGTCAFAANNIR--NMVDNEQTNDILGKG
    08-LsC2C2 --EIESTVNSN-----SLQKIEEAFALKFINACLFASNNLK--NMVYPVCKKDILMIG
   09-LiwC2C2 -----ELTDPK---TKDLQDIRSGEAFSFKFINACAFASNNLK--MILNPECEKDILGKG
   10-LibC2C2 -----ELTDPK---TKDLQDIRSGEAFSFKFINACAFASNNLK--MILNPECEKDILGKG
    13-LspC2c2 NFDSKKFSNKS---DEEKELYKIIYRYLKGRIEKILVNEQKVRL-KKMEKIEIEKILNES
    14-LsC2C2 NFDSKKFSKKS---DEEKELYKIIYRYLKGRIEKILVNEQKVRL-KKMEKIEIEKILNES
  11-Lew1C2C2 -MENGDIATSD-----INMRNRQTEAFLRSIIGVSSFGYFSLR--NILGVNDDDFYETEE
  12-Lew2C2C2 -LQVGEIATSD-----FIARNRQNEAFLRNIIGVSSVAYFSLR--NILETENENDITGRM 601       610       620       630       640       650       660
                |         |         |         |         |         |         |
 15-RcSBC2C2  DRDLTAAVNIRQVIS------------------NKEMVAEAMARR---------GIYFG
  16-RcRC2C2  DRDLTAAVNIRQVIS------------------NKEMVAEAMARR---------GIYFG
01-Lb(MA)C2C2 NYLACATVDTDK-----------------DFLLFSKEDIRSCTKKD--GNLCKNIMQFWG
02-Lb(NK-1)C2C2 RHLSSQTVELDSENSDFLLLKPKGTMDKNDKNKLASNNILNFLKDK--ETLRDTILQYFG
    03-CaC2C2 NNLFRAVVGQTGKKIE----QSKSEENEEDFLLWKAEKIAESIKKEGEGNTLKSILQFFG
04-Lb(NK-2)C2C2 NNLARVTVDIPQNGE-----------KEDILLWNKSDIKKYKKNS--KKGILKSILQFFG
   05-Cg1C2C2 E--------------------------------FKEAIATSSFVN-----YHHFFPYFP
   06-Cg2C2C2 K--------------------------------FKKELEKNVELK--------HDLFFK
    07-PpC2C2 D--------------------------------FIKSLLKDNTNS--------QLYSFFF
    08-LsC2C2 E--------------------------------FKNSFKEIKHKK---FIR-QWSQFFS
   09-LiwC2C2 D--------------------------------FKKNLPNSTTQS---DVVKKMIPFFS
   10-LibC2C2 N--------------------------------FKKNLPNSTTRS---DVVKKMIPFFS
    13-LspC2c2 ILSEKILKRVKQYTLEHIMYLGKLRHNDIVKMTVNTDDFSRLHAKE---ELDLELITFFA
    14-LsC2C2 ILSEKILKRVKQYTLEHIMYLGKLRHNDIDMTTVNTDDFSRLHAKE---ELDLELITFFA
  11-Lew1C2C2 DLTKKKERRNLEKAKE------------DITIKNTFDEVVVKSFQKKGIYNIKENLKMFYG
  12-Lew2C2C2 RGKTVKNNKGEEKY------------------VSGEVDKIYNENKQNEVKENLKMFYS 661       670       680       690       700       710       720
                |         |         |         |         |         |         |
 15-RcSBC2C2  ETPELDRL----------GAEGNEGFV-FALLRYLRGCRNQTFH-L----GARAGFLKE
  16-RcRC2C2  ETPELDRL----------GAEGNEGFV-FALLRYLRGCRNQTFH-L----GARAGFLKE
01-Lb(MA)C2C2 GYSTWKNFCEE-----YLKDDKDALELL-YSLKSMLYSMRNSSFF-F--------STENV
02-Lb(NK-1)C2C2 GHSLWTDFPFDK----YLAGGKDDVDFL-TDLKDVIYSMRNDSPH-Y--------ATENH
    03-CaC2C2 GASSWDLNHFCAAYGNESSALGYETKFA-DDLRKAIYSLRNETFH-F--------TTLNK
04-Lb(NK-2)C2C2 GASTWNMKMFEIAY--HDQPGDYEENYL-YDIIQIIYSLRNKSFH-F--------KTYDH
   05-Cg1C2C2 FELKGMKDRESELIPFGEQTEAKQMQNI-WALRGSVQQIRNEIFHSFDKNQKFNLPQLDK
   06-Cg2C2C2 TEIVEERDENPA----KKIAMTPNELDL-WAIRGAVQRVRNQIFH-QQINKRHEPNQLKV
    07-PpC2C2 GEGLSTNK--------------AEKETQL-WGIRGAVQQIRNNVNH-Y--KKDALKTVFNI
    08-LsC2C2 QEITVDDI--------------ELAS-WGLRGAIAPIRNEIIH-L--KKHSWKKFFNN
   09-LiwC2C2 DEIQNVNF--------------DEAI-WAIRGSIQQIRNEVYH-C--KKHSWKSILKI
   10-LibC2C2 DELQNVNF--------------DEAI-WAIRGSIQQIRNEVYH-C--KKHSWKSILKI
    13-LspC2c2 STNMELNKIFN--------GKEKVTDFFGFNLNGQKITLKEKVPS-FKLNILKKLNFINN
    14-LsC2C2 STNMELNKIFSR----ENINNDENIDFF-GGDREKNYVLDKKILN-SKIKIIRDLDFIDN
  11-Lew1C2C2 DSFDNADK-------------DELKQFF-VNMLNAITSIRHRVVH-Y----NMNTNSENI
  12-Lew2C2C2 YDFNMDNK-------------NEIEDFF-ANIDEAISSIRHGIVH-F------NLELEGK
```

FIG. 53D

```
              721       730       740       750       760       770       780
                |         |         |         |         |         |         |
   15-RcSBC2C2  IRK------ELEKTRWGKAKEAEHVVLTDKTVAAIRAIIDNDAKAL--GARLLA-DLSGA
    16-RcRC2C2  IRK------ELEKTRWGKAKEAEHVVLTDKTVAAIRAIIDNDAKAL--GARLLA-DLSGA
  01-Lb(MA)C2C2 DNG----------------------SWDTELIGKLFEEDCNRA--ARIEKE-KFYNN
02-Lb(NK-1)C2C2 NNG----------------------KWNKELISAMFEHETERM--TVVMKD-KFYSN
       03-CaC2C2 GSF----------------------DWNAKLIGDMFSHEAATG--IAVERT-RFYSN
04-Lb(NK-2)C2C2 GDK----------------------NWNRELIGKMIEHDAERV--ISVERE-KFHSN
      05-Cg1C2C2 SNF------EFDASENSTGKSQ------SYIETDYKFLFEAEKNQL--EQFFIE-RIKSS
      06-Cg2C2C2 GSF--------------ENGDLGNVSYQKTIYQKLFDAEIKDI--EIYFAE-KIKSS
       07-PpC2C2 SNF------ENPTITDPKQQT-------NYADTIYKARFINELEKI--PEAFAQ-QLKTG
       08-LsC2C2 PTF------KVKKSKIINGKTKDVTSEFLYKETLFKDYFYSELDSV--PELIIN-KMESS
      09-LiwC2C2 KGF------EFEPNNM-----------KYTDSDMQKLMDKDIAKI--PDFIEE-KLKSS
      10-LibC2C2 KGF------EFEPNNM-----------KYADSDMQKLMDKDIAKI--PEFIEE-KLKSS
      13-LspC2c2 ENNIDEKLSHFYSFQKEGYLLRNKILHNSYGNIQETKNLKGEYENV--EKLIKELKVSDE
       14-LsC2C2 KNNITN--NFIRKFTKIGTNERNRILHAISKERDLQGT-QDDYNKV--INIIQNLKISDE
      11-Lew1C2C2 FNF---------------------SGIEVSKLLKSIFEKETDKRELKLKIFR-QLNSA
      12-Lew2C2C2 DIF------AFKN-------------IAPSEISKKMFQNEINEKKLKLKIFK-QLNSA 781       790       800       810       820       830       840
                |         |         |         |         |         |         |
   15-RcSBC2C2  FVAHYASKEHFSTLYSEIVKAVKDA------PEVSSGLPRLKLLLKRADGVRGYVHGLRD
    16-RcRC2C2  FVAHYASKEHFSTLYSEIVKAVKDA------PEVSSGLPRLKLLLKRADGVRGYVHGLRD
  01-Lb(MA)C2C2 NLHMFYSSSLLEKVLERLYSSH---------HERASQVPSFNRVFVR----KNFPSSLSE
02-Lb(NK-1)C2C2 NLPMFYKNDDLKKLLIDLYKDN---------VERASQVPSFNKVFVR----KNFPALVRD
       03-CaC2C2 NLPMFYRESDLKRIMDHLYNTY---------HPRASQVPSFNSVFVR----KNFRLFLSN
04-Lb(NK-2)C2C2 NLPMFYKDADLKKILDLLYSDY---------AGRASQVPAFNTVLVR----KNFPEFLRK
      05-Cg1C2C2 GALEYYPLKSLEKLFAKKEMKFSLG------SQVVAFAPSYKKLVK-----KGHSYQTAT
      06-Cg2C2C2 GALEQYSMKDLEKLFSNKELTLSLG------GQVVAFAPSYKKLYK-----QGYFYQNEK
       07-PpC2C2 GAVSYYTIENLKSLLTTFQFSLC--------RSTIPFAPGFKKVFN-----GGINYQNAK
       08-LsC2C2 KILDYYSSDQLNQVFTIPNFELSLL------TSAVPFAPSFKRVYL-----KGFDYQNQD
      09-LiwC2C2 GIIRFYSHDKLQSIWE-MKQGFSLL------TTNAPFVPSFKRVYA-----KGHDYQTSK
      10-LibC2C2 GVVRFYRHDELQSIWE-MKQGFSLL------TTNAPFVPSFKRVYA-----KGHDYQTSK
      13-LspC2c2 EISKSLSLDVIFEGKVDIINKINSLKIGE--YKDKKYLPSFSKIVLEIT--RKFREINKD
       14-LsC2C2 EVSKALNLDVVFKDKKNIITKINDIKISEENNNDIKYLPSFSKVLP-----EILNLYRNN
      11-Lew1C2C2 GVFDYWENRKIDKYLENIEFKFV--------NKNIPFVPSFTKLYN-----RIDNLKGNN
      12-Lew2C2C2 NVFNYYEKDVIIKYLKNTKFNFV--------NKNIPFVPSFTKLYN-----KIEDLRNT- 841       850       860       870       880       890       900
                |         |         |         |         |         |         |
   15-RcSBC2C2  TRKHAFATKLPPPPAPRELDDPATKARYIALLRLYDGP--------------FRAYASGI
    16-RcRC2C2  TRKHAFATKLPPPPAPRELDDPATKARYIALLRLYDGP--------------FRAYASGI
  01-Lb(MA)C2C2 Q-------RITPKFTDSKDEQIWQSAVYYLCKEIYYND--------------FLQSK--E
02-Lb(NK-1)C2C2 KDNLGIELDLKADADKGENELKFYNALYYMFKEIYYNA--------------FLNDK--N
       03-CaC2C2 T------LNTNTSFDTE-VYQKWESGVYYLFKEIYYNS--------------FLPSG--D
04-Lb(NK-2)C2C2 D------MGYKVHFNNPEVENQWHSAVYYLYKEIYYNL--------------FLRDK--E
      05-Cg1C2C2 EGTANY-LGLSYYNRYE-LKEESFQAQYYLLKLIYQYV--------------FLPNFSQG
      06-Cg2C2C2 T------IELEQFTDYD-FSNDVFKANYYLIKLIYHYV--------------FLPQFSQA
       07-PpC2C2 QDESFYELMLEQYLRKENFAEESYNARYFMLKLIYNNL--------------FLPGFT-T
       08-LsC2C2 EAQPDYNLKLNIYNEKA-FNSEAFQAQYSLFKMVYYQV--------------FLPQFT-T
      09-LiwC2C2 NRY--YDLGLTTFDILE-YGEEDFRARYFLTKLVYYQQ--------------FMPWFT-A
      10-LibC2C2 NRY--YNLDLTTFDILE-YGEEDFRARYFLTKLVYYQQ--------------FMPWFT-A
      13-LspC2c2 K----------LFDIE-SEKIILNAVKYVNKILYEKI---TSNEENEFLKTLPDKLV-K
       14-LsC2C2 P-------KNEPFDTIE-TEKIVLNALIYVNKELYKKLILEDDLEENESKNIFLQELK-K
      11-Lew1C2C2 A-------LNLGYINIPK--RKEARDSQIYLLKNIYYGE--------------FVEKFV-N
      12-Lew2C2C2 ---------LKFFWSVP-KDKEEKDAQIYLLKNIYYGE--------------FLNKFV-K
```

FIG. 53E

```
                         901       910       920       930       940       950       960
                          |         |         |         |         |         |         |
        15-RcSBC2C2   TGTALAGPAARA----------KEAATALAQSVNVTKA--------YSDVMEGRTSRLR
        16-RcRC2C2    TGTALAGPAARA----------KEAATALAQSVNVTKA--------YSDVMEGRSSRLR
        01-Lb(MA)C2C2 AYKLFREGVKNL--------DKNDINNQK---------------AADSFKQAVVYYG
        02-Lb(NK-1)C2C2 VRERFITKATKVADNYDRNKERNLKDRIKSAGSDEKKKLREQLQNYIAENDFGQRIKNIV
        03-CaC2C2     AHHLFFEGLRRI----------RKEADNLPIVGKEAKKRN--------AVQDFGRRCDELK
        04-Lb(NK-2)C2C2 VKNLFYTSLKNI---------RSEVSDKKQKL--------------ASDDFASRCEEIE
        05-CglC2C2    NSPAFRETVKAI----------LRINKDEARKKMKKN---------KKFLRKYAFEQVR
        06-Cg2C2C2    NNKLFKDTVHYV----------IQQNKELNTTEKDKKN---------NKKIRKYAFEQVK
        07-PpC2C2     DRKAFADSVGFV-----------QMQNKKQAEKVN-----------PRKKEAYAFEAVR
        08-LsC2C2     NNDLFKSSVDFI----------LTLNK--------------------ERKGYAKAFQDIR
        09-LiwC2C2    DNNAFRDAANFV----------LRLNK--------------------NRQQDAKAFINIR
        10-LibC2C2    DNNAFRDAANFV----------LRLNK--------------------NRQQDAKAFINIR
        13-LspC2c2    KSNNKKENKNLL--SIEEYYKNAQVSSSKGD-KKAIKKYQNKVTNAYLEYLENTFTEIID
        14-LsC2C2     TLGNIDEIDENI---IENYYKNAQISASKGN-NKAIKKYQKKVIECYIGYLRKNYEELFD
        11-Lew1C2C2   NNDNFEKIFREI----------IEINKKDGT----------------NTKTKFYKLEKFE
        12-Lew2C2C2   NSKVFFKITNEV----------IKINKQR------------------NQKTGHYKYQKFE 961       970       980       990       1000      1010      1020
                          |         |         |         |         |         |         |
        15-RcSBC2C2   PPNDGETLREYLSALTGETATEFRVQIGYESDSENARK--QAEFIENYRRDMLAFMFEDY
        16-RcRC2C2    PPNDGETLREYLSALTGETATEFRVQIGYESDSENARK--QAEFIENYRRDMLAFMFEDY
        01-Lb(MA)C2C2 KAIGNATLSQVCQAIMTEYNRQNNDGLKKKSAYAEKQNSNKYKHYPLFLKQVLQSAFWEY
        02-Lb(NK-1)C2C2 QVNPDYTLAQICQLIMTEYNQQNNGCMQKKSAARKDINKDSYQHYKMLLLVNLRKAFLEF
        03-CaC2C2     ----NLSLSAICQMIMTEYNEQNNGNRKVKSTREDKRKPDIFQHYKMLLLRTLQEAFAIY
        04-Lb(NK-2)C2C2 ----DRSLPEICQIIMTEYNAQNFGNRKVKSQRVIEKNKDIFRHYKMLLIKTLAGAFSLY
        05-CglC2C2    EMEFKETPDQYMSYLQSEMREEKVRKAEKNDKGFEKN---ITMNFEKLLMQIFVKGFDVF
        06-Cg2C2C2    LMK-NESPEKYMQYLQREMQEERTIKEAKKTNEEK-----PNYNFEKLLIQIFIKGFDTF
        07-PpC2C2     PMTAADSIADYMAYVQSELMQEQNKKEEKVAEE-------TRINFEKFVLQVFIKGFDSF
        08-LsC2C2     KMNKDEKPSEYMSYIQSQLMLYQKKQEEKE---------KINHFEKFINQVFIKGFNSF
        09-LiwC2C2    EVEEGEMPRDYMGYVQGQIAIHEDSTED-----------TPNHFEKFISQVFIKGFDSH
        10-LibC2C2    EVEEGEMPRDYMGYVQGQIAIHEDSIED-----------TPNHFEKFISQVFIKGFDRH
        13-LspC2c2    FSKFNLNYDEIKTKIEERKDNKSKIIIDSISTNINITN--DIEYIISIFALLNSNTYINK
        14-LsC2C2     FSDFKMNIQEIKKQIKDINDNKTYERITVKTSDKTIVINDDFEYIISIFALLNSNAVINK
        11-Lew1C2C2   TLK-ANAPIEYLEKLQSLHQINYNREKVEE---------DKDIYVDFVQKIFLKGFINY
        12-Lew2C2C2   NIE-KTVPVEYLAIIQSREMINNQDKE------------EKNTYIDFIQQIFLKGFIDY 1021      1030      1040      1050      1060      1070      1080
                          |         |         |         |         |         |         |
        15-RcSBC2C2   I--RAKGFDWILKIEPG------ATAMTRA-----------------------
        16-RcRC2C2    I--RAKGFDWILKIEPG------ATAMTRA-----------------------
        01-Lb(MA)C2C2 LDENKEIYGFISAQIHK------SNVEIKA--------------------EDFIAN
        02-Lb(NK-1)C2C2 I--K-ENYAFVLK--PY------KHDLCDK--------------------ADFVPD
        03-CaC2C2     I--RREEFKFIFDLPKT------LYVMKPV--------------------EEFLPN
        04-Lb(NK-2)C2C2 L--KQERFAFIGKATPI------PYETTDV--------------------KNFLPE
        05-CglC2C2    L-TTFAGKELLLSSEEK------VIKETEI----------------SLSKKINEREKT
        06-Cg2C2C2    L-----RNFDLNLNPAEE------LVGTVKE--------------------KAEGLRKRKER
        07-PpC2C2     L--RAKEFDFVQMPQPQ------LTATASN----------------QQKADKLNQLEAS
        08-LsC2C2     I--EKNRLTYICHPTKN------TVPENDN-----------------------
        09-LiwC2C2    M--RSADLKFIKNPRNQ------GLEQSEI--------------------EE
        10-LibC2C2    M--RSANLKFIKNPRNQ------GLEQSEI--------------------EE
        13-LspC2c2    I--RNRFFATSVWLEKQNGTKEYDYENIISILDEVLLINLLRENNITDILDLKNAIIDAK
        14-LsC2C2     I--RNRFFATSVWLNTS------EYQNIIDILDEIMQLNTLRNECITENWNLNLEEFIQK
        11-Lew1C2C2   L--QGSDLLKSLNLLNL------KKDEAIA--------------------NKKSFYDEKLKL
        12-Lew2C2C2   L--NKNNLKYIESNNNN------DNNDIFSKIKIKKDNKEKYDKILKNYEKHNRNKEIPH
```

FIG. 53F

```
                  1081      1090      1100      1110      1120      1130      1140
                   |         |         |         |         |         |         |
   15-RcSBC2C2   --------PVLPE------------PIDTRGQYEHWQ-AALYLVM-HFVPASDVSN-LLH
    16-RcRC2C2   --------PVLPE------------PIDTRGQYEHWQ-AALYLVM-HFVPASDVSN-LLH
 01-Lb(MA)C2C2   YSSQQ--YKKLVD------------KVKKTPELQKW-----YTLG-RLINPRQANQ-FLG
02-Lb(NK-1)C2C2  FAKYVKPYAGLIS------------RVAGSSELQKW-----YIVS-RFLSPAQANH-MLG
      03-CaC2C2  WKSGM--FDSLVE------------RVKQSPDLQRW-----YVLC-KFLNGRLLNQ-LSG
04-Lb(NK-2)C2C2  WKSGM--YASFVE------------EIKNNLDLQEW-----YIVG-RFLNGRMLNQ-LAG
     05-CglC2C2  LKASIQVEHQLV-------------ATNSAISYW------LFC-KLLDSRHLNE-LRN
      06-CgC2C2  IAKILNVDEQIK-------------TGDEEIAFW------IFA-KLLDARHLSE-LRN
      07-PpC2C2  ITADCKLTPQYA-------------KADDATHIAFY-----VFC-KLLDAAHLSN-LRN
      08-LsC2C2  -------IEIPFH------------TDMDDSNIAFW-----LMC-KLLDAKQLSE-LRN
      09-LiwC2C2 MSFDIKVEPSFLK------------NKDDYIAFW------TFC-KMLDARHLSE-LRN
     10-LibC2C2  MSFDIKVEPSFLK------------NKDDYIAFW------IFC-KMLDARHLSE-LRN
     13-LspC2c2  IVENDETYIKNYI------------FESNEEKLKKR-----LFCEELVDKEDIRKIFED
      14-LsC2C2  MKEIEKDFDDFKI------------QTKKEIFNNYYEDIKNNILT-EFKDDINGCDVLEK
    11-Lew1C2C2  WQNNGSNLSKMPEEIYDYIKKIKINKINYSDRMSIF-----YLLL-KLIDHKELTN-LRG
    12-Lew2C2C2  EINEFVREIKLGK------------ILKYTENLNMF-----YLIL-KLLNHKELTN-LKG 1141      1150      1160      1170      1180      1190      1200
                   |         |         |         |         |         |         |
   15-RcSBC2C2   QLRKWEA--LQGKYELVQDGDA---------------TDQADARREALDLVKRFRDVLVL
    16-RcRC2C2   QLRKWEA--LQGKYELVQDGDA---------------TDQADARREALDLVKRFRDVLVL
 01-Lb(MA)C2C2   SIRNYVQFVKDIQRRAKENGNPI-----RNYYEVLESDSIIKILEMCTKLNGTTSNDIHD
02-Lb(NK-1)C2C2  FLHSYKQYVWDIYRRASETGTEINHSIAEDKIAGVDITDVDAVIDLSVKLCGTISSEISD
      03-CaC2C2  VIRSYIQFAGDIQRRAKANHNRL---YMDNTQRVEYYSNVLEVVDFCIKGTSRFSNVFSD
04-Lb(NK-2)C2C2  SLRSYIQYAEDIERRAAENRNKL---FSKPDEKIEACKKAVRVLDLCIKISTRISAEFTD
     05-CglC2C2  EMIKFKQ--SRIKFNHTQHAELI--------------QNLLPIVELTILSNDYDEKNDSQ
      06-CgC2C2  EMIKFKQ--SSVKKGLIKNGDLI--------------EQMQPILELCILSNDSESME-KE
      07-PpC2C2  ELIKFRESVNEFKF-----------------------HHLLEIIEICLLSADVVPTDYRD
      08-LsC2C2  EMIKFSCSLQSTEEISTF-------------------TKAREVIGLALLNGEKGCNDWKE
     09-LiwC2C2  EMIKYDGHL----------------------------TGEQEIIGLALLGVDSRENDWKQ
     10-LibC2C2  EMIKYDGHL----------------------------TGEQEIIGLALLGVDSRENDWKQ
     13-LspC2c2  ENFKFKSFIKKNEIGNFKINFGI---------LSNLECNSEVEAKKIIGKNSKKLESFIQN
      14-LsC2C2  KLEKIVIFDDETKFEIDKKSNIL--------------QDEQR--KLSNINKKDLKKKVDQ
    11-Lew1C2C2  NLEKYVSMNKNKIY-----------------------SEELNIVNLVSLDNNKVRANFNL
    12-Lew2C2C2  SLEKYQSANKEETF-----------------------SDELELINLLNLDNNRVTEDFEL 1201      1210      1220      1230      1240      1250      1260
                   |         |         |         |         |         |         |
   15-RcSBC2C2   FLKTGEA-----------RFEGRAAPFDLKPFRALFANPATFDRLFM-ATPTTARPAED
    16-RcRC2C2   FLKTGEA-----------RFEGRAAPFDLKPFRALFANPATFDRLFM-ATPTTARPAED
 01-Lb(MA)C2C2   YFRDEDE-----------YAEYISQFVNFGDV-------HSGAALNAFCNSE-SEGKKN
02-Lb(NK-1)C2C2  YFKDDEV-----------YAEYISSYLDFEYDG-----GNYKDSLNRFCNSDAVNDQKV
      03-CaC2C2  YFRDEDA-----------YADYLDNYLQFKDEKI--AEVSSFAALKTFCNEE---EVKA
04-Lb(NK-2)C2C2  YFDSEDD-----------YADYLEKYLKYQDDAIKELSGSSYAALDHFCNKD---DLKF
     05-CglC2C2  NVDVSA------------YFEDKSLYET--------------APYVQTD-------
      06-CgC2C2  SFDKIEV-----------FLEKVELAKN--------------EPYMQED-------
      07-PpC2C2  LYSSEAD-----------CLARLRPFIEQGADITNWS-------DLFVQSD-------
      08-LsC2C2  LFDDKEA-----------WKKNMSLYVSEELLQS----------LPYTQED-------
     09-LiwC2C2  FFSSERE-----------YEKIMKGYVGEELYQR----------EPYRQSD-------
     10-LibC2C2  FFSSERE-----------YEKIMKGYVVEELYQR----------EPYRQSD-------
     13-LspC2c2  IIDEYKSNIRTLF------SSEFLEKYKEEIDNLVEDTESENKNKFEKIYYPK---EHKN
      14-LsC2C2  YIKDKDQEIKSKILCRIIFNSDFLKKYKKEIDNLIEDMESENENKFQEIYYPK---ERKN
    11-Lew1C2C2  ------------------KPEDIGKFLKTETSIRNINQLNNFS--EIFAD---------
    12-Lew2C2C2  EANEIGK-----------FLDFNENKIKDRKEL----------KKFDTNK-------
```

FIG. 53G

```
              1261      1270      1280      1290      1300      1310      1320
                |         |         |         |         |         |         |
 15-RcSBC2C2  DPEGDGASEPELRVARTLRGLRQIAR-YNHMAVLSDLFAKH------------KVRDEE
  16-RcRC2C2  DPEGDGASEPELRVARTLRGLRQIAR-YNHMAVLSDLFAKH------------KVRDEE
01-Lb(MA)C2C2  GIYYD-GIN-----PIVNRNWVLCKL-YGSPDLISKIIS-------------RVNENM
02-Lb(NK-1)C2C2 ALYYD-GEH-----PKLNRNIILSKL-YGERRFLEKITD-------------RVSRSD
    03-CaC2C2  GIYMD-GEN-----PVMQRNIVMAKL-FGPDEVLKNVVP-------------KVTREE
04-Lb(NK-2)C2C2 DIYVNAGQK-----PILQRNIVMAKL-FGPDNILSEVME-------------KVTESA
    05-CglC2C2  ------DRT-----RVSFRPILKLEK-YHTKSLIEALLKDN----------PQFRVAATD
    06-CgC2C2   ------KLT-----PVKFRFMKQLEK-YQTRNFIENLVIEN----------PEFKVSEKI
    07-PpC2C2   ------KHS-----PVIHANIELSVK-YGTTKLLEQIINKD----------TQFKTTEAN
    08-LsC2C2   ------GQT-----PVINRSIDLVKK-YGTETILEKLFSSS----------DDYKVSAKD
    09-LiwC2C2  ------GKT-----PILFRGVEQARK-YGTETVIQRLFDAS----------PEFKVSKCN
    10-LibC2C2  ------GKT-----PILFRGVEQARK-YGTETVIQRLFDAN----------PEFKVSKCN
    13-LspC2c2  ELYIY-KKN-----LFLNIGNPNFDKIYGLISKDIKNVDTKILFD---DDIKKNKISEID
    14-LsC2C2   ELYIY-KKN-----LFLNIGNPNFDKIYGLISNDIKMADAKFLFNIDGKNIRKNKISEID
   11-Lew1C2C2  ------GEN-----VIKHRSFYNIKK-YGILDLLEKIVDKA-----------DLKITKEE
   12-Lew2C2C2  -IYFD-GEN-----IIKHRAFYNIKK-YGMLNLLEKIADKA-----------KYKISLKE 1321      1330      1340      1350      1360      1370      1380
                |         |         |         |         |         |         |
 15-RcSBC2C2  --VARLAEIEDETQEKSQIVAAQELRTDLHDK--------------VMKCHPKTISPEER
  16-RcRC2C2  --VARLAEIEDETQEKSQIVAAQELRTDLHDK--------------VMKCHPKTISPEER
01-Lb(MA)C2C2  --IHDFHKQEDLIRE---YQIKGICSNKKEQQ----------------------------
02-Lb(NK-1)C2C2 --IVEYYKLKKETSQ---YQTKGIFDSEDEQK----------------------------
    03-CaC2C2  --IEEYYQLEKQIAP---YRQNGYCKSEEDQK----------------------------
04-Lb(NK-2)C2C2 --IREYYDYLKKVSG---YRVRGKCSTEKEQE----------------------------
    05-CglC2C2 --IQEWMHKREEIGEL--VEKRKNLHTEWAEG------------------QQTLGAEKR
    06-CgC2C2  --VLNWHEEKEKIADL--VDKRTKLHEEWASKAREIEEYNEKIKKNKSKKLDKPAEFAKF
    07-PpC2C2  --FTAWNTAQKSIEQL--IKQREDHHEQWVKA-------KNADDKEKQERKREKSNFAQK
    08-LsC2C2  --IAKLHEY--DVTEK--IAQQESLHKQWIEK---------------PGLARDSAWTKK
    09-LiwC2C2 --ITEWERQKETIEET--IERRKELHNEWEKN---------------PKKPQNNAFFKE
    10-LibC2C2 --LAEWERQKETIEET--IKRRKELHNEWAKN---------------PKKPQNNAFFKE
    13-LspC2c2 AILKNLNDKLNGYSND--YKAKYVNKLKENDD---------------FFAKNIQNENYSSF
    14-LsC2C2  AILKNLNDKLNGYSKE--YKEKYIKKLKENDD---------------FFAKNIQNKNYKS-
   11-Lew1C2C2 --IKKYENLQNELKRNDFYKIQERIHRNYNQK---------------PFLIKNNEKDFND-
   12-Lew2C2C2 --LKEYSNKKNEIEKN--YTMQQNLHRKYARP---------------KKDEKFNDEDYKE- 1381      1390      1400      1410      1420      1430      1440
                |         |         |         |         |         |         |
 15-RcSBC2C2  ------QSYAAAIKTIEEHRFLVGRVYLGDHLRLHRLMMDVIGRLIDYAGAYERDTGTFL
  16-RcRC2C2  ------QSYAAAIKTIEEHRFLVGRVYLGDHLRLHRLMMDVIGRLIDYAGAYERDTGTFL
01-Lb(MA)C2C2 --------------DLRTFQVLKNRVELRDIVEYSEIINELYGQLIKWCYLRERDLMYFQ
02-Lb(NK-1)C2C2 --------------NIKKFQEMKNIVEFRDLMDYSEIADELQGQLINWIYLRERDLMNFQ
    03-CaC2C2  --------------KLLRFQRIKNRVEFQTITEFSEIINELLGQLISWSFLRERDLLYFQ
04-Lb(NK-2)C2C2 --------------DLLKFQRLKNAVEFRDVTEYAEVINELLGQLISWSYLRERDLLYFQ
    05-CglC2C2 ------EEYRDYCKKIDRFNWKANKVTLYLSQLHYLITDLLGRMVGFSALFERDLVYFS
    06-CgC2C2  ------AEYKIICEAIENFNRLDHKVRLTYLKNLHYLMIDLMGRMVGFSVLFERDFVYMG
    07-PpC2C2  FIEKHGDDYLDICDYINTYNWLDNKMHFVHLNRLHGLTIELLGRMAGFVALFDRDFQFFD
    08-LsC2C2  --------YQNVINDISNYQWAKTKVELTQVRHLHQLTIDLLSRLAGYMSIADRDFQFSS
    09-LiwC2C2 --------YKECCDAIDAYNWHKNKTTLVYVNELHHLLIEILGRYVGYVAIADRDFQCMA
    10-LibC2C2 --------YKECCDAIDAYNWHKNKTTLAYVNELHHLLIEILGRYVGYVAIADRDFQCMA
    13-LspC2c2 ------GEFEKDYNKVSEYKKIRDLVEFNYLNKIESYLIDINWKLAIQMARFERDMHYIV
    14-LsC2C2  --------FEKDYNRVSEYKKIRDLVEFNYLNKIESYLIDINWKLAIQMARFERDMHYIV
   11-Lew1C2C2 --------YKKAIENIQNYTQLKNKIEFNDLNLLQSLLFRILHRLAGYTSLWERDLQFKL
   12-Lew2C2C2 --------YEKAIGNIQKYTHLKNKVEFNELNLLQGLLLKILHRLVGYTSIWERDLRFRL
```

FIG. 53H

```
                    1441       1450      1460      1470      1480      1490      1500
                      |          |         |         |         |         |         |
    15-RcSBC2C2    IN-----------------------------------------------------------
    16-RcRC2C2     IN-----------------------------------------------------------
    01-Lb(MA)C2C2  LGFHYLCLNNASSKEADYIKI---NVDDRNISGAILYQIAAMYINGLPVYYKKDDMYVAL
    02-Lb(NK-1)C2C2 LGYHYACLNNDSNKQATYVTLDYQGKKNRKINGAILYQICAMYINGLPLYYVDKDSSEWT
    03-CaC2C2      LGFHYLCLHNDTEKPAEYKEIS--REDGTVIRNAILHQVAAMYVGGLPVYTLADKKLAAF
    04-Lb(NK-2)C2C2 LGFHYMCLKNKSFKPAEYVDIR--RNNGTIIHNAILYQIVSMYINGLDFYSCDKEGKTLK
    05-Cg1C2C2     RS--FSELGGETYHISDYKNLSGVLRLNAEVKPIKIKNIKVIDNEENPYKG---------
    06-Cg2C2C2     RS--YSALKKQSIYLNDYDT----FANIRDWEVNENKHLFGTSSSDLTFQ---------
    07-PpC2C2      EQ-----QIADEFKLHGFVNLHSIDKKLNEVPTKKIKEIYDIRNKIIQI-----------
    08-LsC2C2      NY--ILERENSEYRVTSWIL----LSENKNKNKYNDYELYNLKNASIKVSSK--------
    09-LiwC2C2     NQ--YFKHSGITERVEYW------------------------------------------
    10-LibC2C2     NQ--YFKHSGITERVEYW------------------------------------------
    13-LspC2c2     NG----LRELGIIKLSGYN------TGISRAYPKRNGSDGFYTTTAYYKFF---------
    14-LsC2C2      NG----LRELGIIKLSGYN------TGISRAYPKRNGSDGFYTTTAYYKFF---------
    11-Lew1C2C2    KG--EYPENKYIDEIFNFD-----NSKNKIYNEKNERGGSVVSKYGYFLVEK--------
    12-Lew2C2C2    KG--EFPENHYIEEIFNFDNSKNVKYKSGQIVEKYINFYKELYKDNVEKRSI--------

1501       1510      1520      1530      1540      1550      1560
                      |          |         |         |         |         |         |
    15-RcSBC2C2    ------------------ASKQLGAGAD-----------------WAVTIAGAANTDA--
    16-RcRC2C2     ------------------ASKQLGAGAD-----------------WAVTIAGAANTDA--
    01-Lb(MA)C2C2  KSGKKASDELNSNE--QTSKKINYFLKYGNNIL-G-------DKKDQLYLAGLELFENVA
    02-Lb(NK-1)C2C2 VSDGKES---------TGAKIGEFYR----------YAKSFENTSDCYASGLEIFENIS
    03-CaC2C2      EKGEADCKLSISKDTAGAGKKIKDFFRYSKYVLIKDRMLTDQNQKYTIYLAGLELFENTD
    04-Lb(NK-2)C2C2 PIETGK----------GVGSKIGQFIKYSQY------LYNDPSYKLEIYNAGLEVFENID
    05-Cg1C2C2     ------------------NEPEVKPFLD-----------------RLHAYLENVIGIKA--
    06-Cg2C2C2     ------------------ETAEFKNLKK-----------------PMENQLKALLGVTN--
    07-PpC2C2      ------------------NGNKINESVR---------ANLIQFISSKRNYYNNAFLHVSNDE
    08-LsC2C2      ------------------NDPQLKVDLK-----------------QLRLTLEYLELFDN--
    09-LiwC2C2     ------------------GDNRLKSIKK-----------------LDTFLKKEGLFVS--
    10-LibC2C2     ------------------GDNRLKSIKK-----------------LDTFLKKEGLFVS--
    13-LspC2c2     ------------------DEESYKKFEK-----------------ICYGFGIDLSENSE
    14-LsC2C2      ------------------DEESYKKFEK-----------------ICYGFGIDLSENSE
    11-Lew1C2C2    ------------------DGEIQRKNAR------------DKKKNKIIKKEGLE------
    12-Lew2C2C2    ------------------YSDKKVKKLKQ---------------EKKDLY----------

1561       1570      1580      1590      1600      1610      1620
                      |          |         |         |         |         |         |
    15-RcSBC2C2    ----RTQ-TRKDLAHFNVLDRA--DGTPDLTALVNRARE-MMAYDRKRKNAVPRSILDML
    16-RcRC2C2     ----RTQ-TRKDLAHFNVLDRA--DGTPDLTALVNRARE-MMAYDRKRKNAVPRSILDML
    01-Lb(MA)C2C2  EHENIII-FRNEIDHFHYFYDR----DRSMLDLYSEVFDRFFTYDMKLRKNVVNMLYNIL
    02-Lb(NK-1)C2C2 EHDNITE-LRNYIEHFRYYSSF----DRSFLGIYSEVFDRFFTYDLKYRKNVPTILYNIL
    03-CaC2C2      EHDNITD-VRKYVDHFKYYATS-DENAMSILDLYSEIHDRFFTYDMKYQKNVANMLENIL
    04-Lb(NK-2)C2C2 EHDNITD-LRKYVDHFKYYAYG---NKMSLLDLYSEFFDRFFTYDMKYQKNVVNVLENIL
    05-Cg1C2C2     ----VHGKIRNQTAHLSVLQLE-----LSMIESMNNLRD-LMAYDRKLKNAVTKSMIKIL
    06-Cg2C2C2     ----HSFEIRNNIAHLHVLRNDGKGEGVSLLSCMNDLRK-LMSYDRKLKNAVTKAIIKIL
    07-PpC2C2      IKEKQMYDIRNHIAHFNYLTKD--AADFSLIDLINELRE-LLHYDRKLKNAVSKAFIDLF
    08-LsC2C2      ----RLKEKRNNISHFNYLNGQ---LGNSILELFDDARD-VLSYDRKLKNAVSKSLKEIL
    09-LiwC2C2     ----EKN-ARNHIAHLNYLSLK---SECTLLYLSERLRE-IFKYDRKLKNAVSKSLIDIL
    10-LibC2C2     ----EKN-ARNHIAHLNYLSLK---SECTLLYLSERLRE-IFKYDRKLKNAVSKSLIDIL
    13-LspC2c2     INKPENESIRNYISHFYIVRNP--FADYSIAEQIDRVSN-LLSYSTRYNNSTYASVFEVF
    14-LsC2C2      INKPENESIRNYISHFYIVRNP--FADYSIAEQIDRVSN-LLSYSTRYNNSTYASVFEVF
    11-Lew1C2C2    --------IRNYIAHFNYIPDA----TKSILEILEELRN-LLKYDRKLKNAVMKSIKDIF
    12-Lew2C2C2    --------IRNYIAHFNYIPHA----EISLLEVLENLRK-LLSYDRKLKNAIMKSIVDIL
```

FIG. 53I

```
              1621       1630      1640      1650      1660      1670      1680
                |          |         |         |         |         |         |
  15-RcSBC2C2  ARLGLTLKWQ--MKDHLLQDATITQAAIKHLDKVRLTVGGPAAVTEARFSQDYLQMVAAV
   16-RcRC2C2  ARLGLTLKWQ--MKDHLLQDATITQAAIKHLDKVRLTVGGPAAVTEARFSQDYLQMVAAV
 01-Lb(MA)C2C2 LDHNIVSSFVFETGEKKVGRGDSEVI----KPSAKIRLRANNGVSSDVFTYKVGSKDE-L
02-Lb(NK-1)C2C2 LQHFVNVRFEFVSGKKMIGIDKKDRKIAKEKECARITIREKNGVYSEQFTYKLK-----N
    03-CaC2C2  LRHFVLIRPEFFTGSKKVGEGKKITC----KARAQIEIAE-NGMRSEDFTYKLSDGKKNI
04-Lb(NK-2)C2C2 LRHFVIFYPKFGSGKKDVGIRDCKKE------RAQIEISE-QSLTSEDFMFKLDDKAG-E
    05-CglC2C2 DKHGMILKLK---------IDENHKN----------------------------------F
    06-Cg2C2C2 DKHGMILKLT---------NNDHTKP----------------------------------F
    07-PpC2C2  DKHGMILKLK----------LNADHK----------------------------------L
    08-LsC2C2  SSHGMEVTFK--------PLYQTNHH----------------------------------L
    09-LiwC2C2 DRHGMSVVFA--------NLKENKHR----------------------------------L
    10-LibC2C2 DRHGMSVVFA--------NLKENKHR----------------------------------L
    13-LspC2c2 KKDVNLDYDELKKKFRLIGNNDILER----------------------------------
    14-LsC2C2  KKDVNLDYDELKKKFKLIGNNDILER----------------------------------
   11-Lew1C2C2 KEYGLIIEFK--------ISHVNNSEK---------------------------------I
   12-Lew2C2C2 KEYGFVATFK----------IGADKK----------------------------------I 1681       1690      1700      1710      1720      1730      1740
                |          |         |         |         |         |         |
  15-RcSBC2C2  FNGSVQNPKPRRRDDGDAWHKPPKPATAQSQPDQKPPNKAPSAGSRLP-----PPQVG--
   16-RcRC2C2  FNGSVQNPKPRRRDDGDAWHKPPKPATAQSQPDQKPPNKAPSAGSRLP-----PPQVG--
 01-Lb(MA)C2C2 KIATLPAKNEEFLLNVARLIYYPDMEAVSENMVREGVVKVEKSNDKKGKISRGSNTRSSN
02-Lb(NK-1)C2C2 GTVYVDARDKRYLQSIIRLLFYPEKVNMDEMIEVKEKKKPSDNNTGKGYSKRDRQQDR--
    03-CaC2C2  STCMIAARDQKYLNTVARLLYYPHEAK-KSIVDTREKKNNKKTNRGDGTFNKQKGTAR--
04-Lb(NK-2)C2C2 EAKKFPARDERYLQTIAKLLYYPNEIEDMNRFMKKGETINKKVQFNRKKKIT-RKQKN--
    05-CglC2C2 EIESLIPKEIIHL---------------------------KDKAIK-------TNQVS--
    06-Cg2C2C2 EIESLKPKKIIHL---------------------------EKSNHSFP-----MDQVS--
    07-PpC2C2  KVESLEPKKIYHL---------------------------GSSAKDKPEYQYCTNQVM--
    08-LsC2C2  KIDKLQPKKIHHL---------------------------GEKSTVS------SNQVS--
    09-LiwC2C2 VIKSLEPKKLRHL---------------------------GEKKIDNGYIE--TNQVS--
    10-LibC2C2 VIKSLEPKKLRHL---------------------------GGKKIDGYIE--TNQVS--
    13-LspC2c2 ---LMKPKKVSVL---------------------------ELESYN-------SDYIK--
    14-LsC2C2  ---LMKPKKVSVL---------------------------ELESYN-------SDYIK--
   11-Lew1C2C2 EVLNVDSEKIKHL---------------------------KNNGLV-------TTRNS--
   12-Lew2C2C2 EIQTLESEKIVHL---------------------------KNLKKKKLM----TDRNS--

1741       1750      1760      1770      1780      1790      1800
                |          |         |         |         |         |         |
  15-RcSBC2C2  -EVYEGVVVKVIDTGSLGFLAVEGVAGNIGLHISRLRRIREDAIIVGRRYRFRVEIYVPP
   16-RcRC2C2  -EVYEGVVVKVIDTGSLGFLAVEGVAGNIGLHISRLRRIREDAIIVGRRYRFRVEIYVPP
 01-Lb(MA)C2C2 QSKYNNKSKNRMNYSMGSIFEKMDLKFD--------------------------------
02-Lb(NK-1)C2C2 -KEYDKYKEKKKKEGNFLSGMGGNINWDEINAQLKN------------------------
    03-CaC2C2  -KEKDNGPREFNDTGFSNTPFAGFDPFRNS------------------------------
04-Lb(NK-2)C2C2 -NSSNEVLSSTMGYLFKNIKL---------------------------------------
    05-CglC2C2 -EEYCQLVLALLTTNPGNQLN---------------------------------------
    06-Cg2C2C2 -QEYCDLVKKMLVFTN--------------------------------------------
    07-PpC2C2  -MAYCNMCRSLLEMKK--------------------------------------------
    08-LsC2C2  -NEYCQLVRTLLTMK---------------------------------------------
    09-LiwC2C2 -EEYCGIVKRLLEI----------------------------------------------
    10-LibC2C2 -EEYCGIVKRLLEM----------------------------------------------
    13-LspC2c2 -NLIIELLTKIENTNDTL------------------------------------------
    14-LsC2C2  -NLIIELLTKIENTNDTL------------------------------------------
   11-Lew1C2C2 -EDLCELIKMMLEYKKS-------------------------------------------
   12-Lew2C2C2 -EELCELVKVMFEYKALE------------------------------------------
```

FIG. 53J

```
                    1801      1810      1820      1830      1840      1850      1860
                      |         |         |         |         |         |         |
       15-RcSBC2C2  KSNTSKLNAADLVRID
        16-RcRC2C2  KSNTSKLNAADLVRID
      01-Lb(MA)C2C2  ----------------
     02-Lb(NK-1)C2C2 ----------------
          03-CaC2C2  ----------------
     04-Lb(NK-2)C2C2 ----------------
         05-Cg1C2C2  ----------------
         06-Cg2C2C2  ----------------
          07-PpC2C2  ----------------
          08-LsC2C2  ----------------
         09-LiwC2C2  ----------------
         10-LibC2C2  ----------------
         13-LspC2c2  ----------------
          14-LsC2C2  ----------------
        11-Lew1C2C2  ----------------
        12-Lew2C2C2  ----------------
```

FIG. 53K

| | SEQ ID NO: | | SEQ ID NO: | |
|---|---|---|---|---|
| | | 586         603 | | 1276         1290 |
| c2c2_Leptotrichia shahii | 547 | IRKFTRIGTN ERRRILHA | 548 | SIRNYISHF YIVRSP |
| c2c3-5 Lachnospiraceae bacterium MA2020 | 549 | LYSLKSMLYS RRRSSFHF | 550 | IFRKEIDHF HYFYDR |
| c2c3-6 Lachnospiraceae | 551 | LTDLKQVIYS RRRDGFHY | 552 | ELRRYIEHF RYYSSF |
| c2c3-7 [Clostridium] aminophilum DSM 10710 | 553 | ADDLRKAIYS LRNEIFHF | 554 | DVRKYVDHF KYYATS |
| c2c3-8 Carnobacterium gallinarum DSM 4847 | 555 | IRALRGSVQQ IRNEIFHS | 556 | KIRNQTAHF SVLQLE |
| c2c3-9 Carnobacterium gallinarum DSM 4847 | 557 | LRAIRGAVQR VRNQIFHQ | 558 | EIRNEIAHF RVLRSD |
| c2c3-10 Paludibacter propionicigenes WB4 | 559 | LRGIRGAVQQ IRRNVSHY | 560 | DIRNHIAHF NYLTKD |
| c2c3-11 Listeria weihenstephanensis FSL R9-0317 | 561 | IRAIRGSIQQ IRREVYHC | 562 | NARNHIAHF NYLSLK |
| c2c3-12 Listeriaceae bacterium FSL M6-0635 | 563 | IRAIRGSIQQ IRREVYHC | 564 | NARNHIAHF NYLSLK |
| c2c3-13 Leptotrichia wadei F0279 | 565 | FANIDEAISS IRKGIVHF | 566 | YIRNYIAHF NYIPHA |
| c2c3-14 Rhodobacter capsulatus SB 1003 | 567 | VFALLRYLRG CRNQTFHL | 568 | QTRKDLAHF NVLDRA |
| c2c3-15 Rhodobacter capsulatus R121 | 569 | VFALLRYLRG CRNQTFHL | 570 | QTRKDLAHF NVLDRA |
| c2c3-16 Rhodobacter capsulatus DE442 | 571 | VFALLRYLRG CRNQTFHL | 572 | QTRKDLAHF NVLDRA |
| c2-3 L. wadei (Lw2) | 573 | FANIDEAISS IRKGIVHF | 574 | YIRNYIAHF NYIPHA |
| c2-4 Listeria seeligeri | 575 | SRGLRGAIAP IRNEITHR | 576 | ERRNISHF NYLRQ |

FIG. 53L

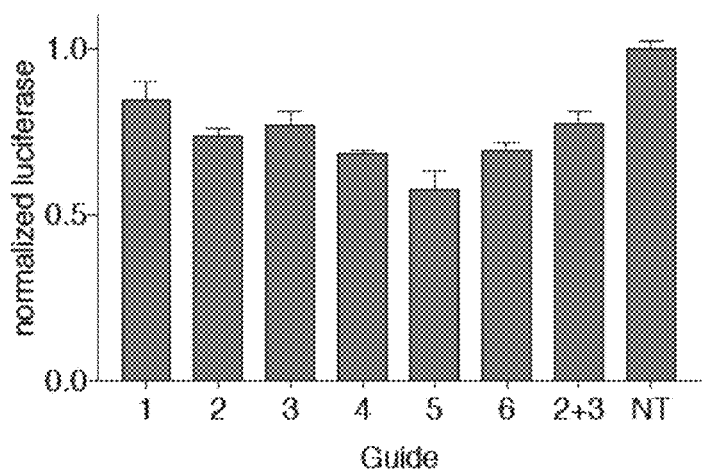
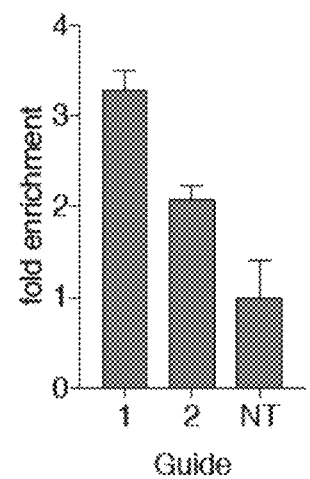
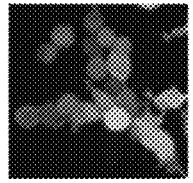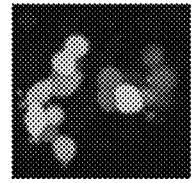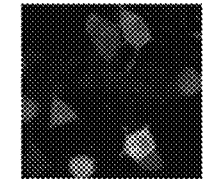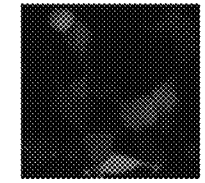
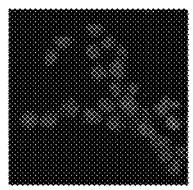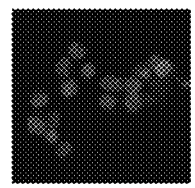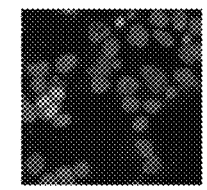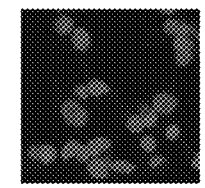
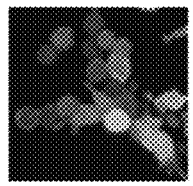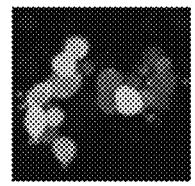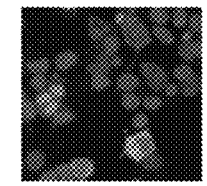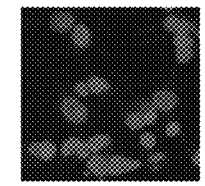
Fig. 63A-63C

SEQ ID NO: 66
>LibFSL and Lw2  Alignment of 2 sequences: 10-LibC2C2, 12-Lew2C2C2
SEQ ID NO: 67
Identities = 782/1752 (44%),
Positives = 995/1752 (56%), Gaps = 1301/1752 (74%)

```
10-LibC2C2     1 ------------------------------------MKITKMRVDG----------RTIVME    16
                                                     MK+TK+          I  +
12-Lew2C2C2    1 ------------------------------------MKVTKVDG-------------ISHK    12

10-LibC2C2    17 RTSKEGQLGYEG--------IDGNKTTEIIFDKK-KESFYKSILNKTVRK----------    57
                  + +EG+L         + N+T+E + + -        I N          
12-Lew2C2C2   13 KYIEEGKLVKST--------SEENRTSERLSELL-SIRLDIYIKNPDNA-----------    52

10-LibC2C2    58 PDEKEKNRRKQAINKAINKEITE------LMLAVLHQEV--------------------    90
                 +E+ + RR     + + K  + ------ +L +    +-------------------
12-Lew2C2C2   53 SEEENRIRR-----ENLKKFFSN------KVLHLKDSVL--------------------    80

10-LibC2C2    91 ---------PSQKLHNLKSLNTES---LTKLFKPKFQNMISYPPSKGAE-----HVQFCL   133
                 ---------      L N K   N --- +       Y        -----
12-Lew2C2C2   81 ------------YLKNRKEKNAVQ---DKNYSEEDISE---YDLKNKNS-----FSVLKK   117

10-LibC2C2   134 TDIAVPAIR---DLDEIKPD---WGIFFEKLKPYTDWAESYIHY--KQTTIQKS------   179
                     +       ---D++ + +--- IF + ++    + S  + + + ------
12-Lew2C2C2  118 ILLNE-------DVNSEELE-----IFRKDVEAKLNKINSLKYSFEENKANYQK------   159

10-LibC2C2   180 --IEQNK---------IQSPD-------SPRKLVLQKY--VTAFLNGEPLGLDLV-----   214
                 --I +N ------ + ------- R ++  Y       +           +
12-Lew2C2C2  160 --INENN------VEKVGGKS--------KRNIIYDYYRESAKRNDYINNVQEAFDKLYK   203

10-LibC2C2   215 ----------------------AKKYKLADLAESFKLVDLNEDK------------    236
                 ----------     +KYK+ +          +++         ---
12-Lew2C2C2  204 KEDIEKLFFLIENSKK----------HEKYKIREYYHKIIGRKNDKENFAKIIYEEI---   250

10-LibC2C2   237 --------SANYKIKACLQQH------------QRNILD--ELKEDPELNQY----GIEV   270
                 --------         IK +++          + LD EL +    +    IE+
```

Fig. 67A

```
12-Lew2C2C2  251 -----QNVNNIKELIEKIPDMSELKKSQVFYKYYLDKEELNDKNIKYAFCHFVEIEM     302

10-LibC2C2   271 KKYI---QRYFPIKRAPNR-SKHARADFLKKELIESTVEQQFKNAVYHYVLEQGKMEAY-  325
                 + +---  + +    KR  N -S         + + ++  +E +  N +  YV   GK   Y-

12-Lew2C2C2  303 SQLL----KNYVYKRLSNI-SNDKIKRIFEYQNLKKLIENKLLNKLDTYVRNCGKYNYY-  356

10-LibC2C2   326 --ELTDPKTKD--------------------LQDIRSGEAFSFKFINACAFASNNL-KM  361
                 - ++  +  T  D--------------------  +   R   EAF   I    + A  +L-+

12-Lew2C2C2  357 -LQVGEIATSD--------------------FIARNRQNEAFLRNIIGVSSVAYFSL-RN  394
```

Fig. 67B

```
10-LibC2C2    362 ILNP------ECE---------------KDILG---KGNFKKNLPNS------------- 384
                  IL     ------E E--------------- DI G---+   K     N

12-Lew2C2C2   395 ILET------ENE---------------NDITG---RMRGKTVKNNKGEEKYVSGEVDKI 430

10-LibC2C2    385 ---TTRSDVVKKMIPFFS----------DELQNVNFD-----EAIWA-IRGSIQQIRNEV 425
                     +++V + + F+S----------  +     N +---  E  +A I  +I   IR+ +

12-Lew2C2C2   431 YNENKQNEVKENLKMFYS----------YDFNMDNKN---EIEDFFANIDEAISSIRHGI 477

10-LibC2C2    426 YH-C--KKHSWKSILKIKGFEFEPNNM------------KYADSDMQKLMDKDIA--KIP 468
                  H-  --        +     F F+    ------------      +K+   +I   K+

12-Lew2C2C2   478 VH-F------NLELEGKDIFAFKN---------------IAPSEISKKMFQNEINEKKLK 515

10-LibC2C2    469 EFIEEKLKSSGVVRFYRHDELQSIWEM-KQGFSLLTTNAPFVPSFKRVYAKG---HDYQT 524
                  I ++L S+ V  +Y   D +   + -   F+ +  N PFVPSF ++Y K ---  D +

12-Lew2C2C2   516 LKIFKQLNSANVFNYYEKDVIIKYLK--NTKFNFVNKNIPFVPSFTKLYNKI---EDLRN 570

10-LibC2C2    525 SKN--RYYNLDLTT---FDILE-YGEEDFRARYFLTKLVYYQQFMPWFT-ADNNAFRDAA 577
                  +  --        L   ---F + - +E+  A+ +L K +YY +F+   F - ++  F

12-Lew2C2C2   571 T----------LKF---FWSVP-KDKEEKDAQIYLLKNIYYGEFLNKFV-KNSKVFFKIT 615

10-LibC2C2    578 NFV--------LRLNKNRQQDAK-----------------AFINIREVEEGEMPRDYM 610
                  N V--------+++NK R Q   -----------------  +     +E   +P +Y+

12-Lew2C2C2   616 NEV--------IKINKQRNQKTG-----------------HYKYQKFENIE-KTVPVEYL 649

10-LibC2C2    611 GYVQGQIAIH---------------EDSIEDTPN-HFEKFISQVFIKGFDRHM--RSANL 652
                  +Q + I+---------------    ++ N- + FI Q+F+KGF ++--    NL

12-Lew2C2C2   650 AIIQSREMINN---------------QDKEEKN-TYIDFIQQIFLKGFIDYL--NKNNL 690

10-LibC2C2    653 KFIKNPRNQGLEQSEI-------------------------------EEMSFDIKVEPS 680
                  K+I++  N                                       E    +IK+

12-Lew2C2C2   691 KYIESNNNNDNNDIFSKIKIKKDNKEKYDKILKNYEKHNRNKEIPHEINEFVREIKLGKI 750
```

Fig. 67C

```
10-LibC2C2    681 FLKNKDD-YIAFWIFCKMLDARHLSELRNEMIKYDGHL-------------------- 717
                  ++ -   F++  K+L+ + L+ L+   + KY                 ----------------

12-Lew2C2C2   751 LKYTEN--LNMFYLILKLLNHKELTNLKGSLEKYQSANKEETF---------------- 791

10-LibC2C2    718 ------TGEQEIIGLALLGVDSRENDWKQFFSSEREYEKIMKGYVVEE------------ 759
                  ------+ E E+I L   L  +    D++   +   ++    +   + +   ----------

12-Lew2C2C2   792 ------SDELELINLLNLDNNRVTEDFELEANEIGKFLDFNENKIKDRKE---------- 835

10-LibC2C2    760 --LYQ-REPY--------RQSD-GKTPILF-----RGVEQARKYGTETVIQRLFDANPEF 802
                  --L +            --------  D-G+  I  -----R     +KYG    ++++ D    ++

12-Lew2C2C2   836 --LKKFDTNK--------IYFD-GENIIKH-----RAFYNIKKYGMLNLLEKIADKA-KY 878
```

Fig. 67D

```
10-LibC2C2    803 KVSKCNLAEWERQKETIEET--IKRRKELHNEWAK----------------NPKKPQN  842
                  K+S   L E+  +K  IE+ --   ++ LH ++A+----------------   + N

12-Lew2C2C2   879 KISLKELKEYSNKKNEIEKN--YTMQQNLHRKYAR----------------PKKDEKFN  919

10-LibC2C2    843 NAFFKEYKECCDAIDAYNWHKNKTTLAYVNELHHLLIEILGRYVGYVAIADRDFQCMANQ  902
                  +  +KEY++     I  Y   KNK     +N L  LL++IL R VGY +I +RD +

12-Lew2C2C2   920 DEDYKEYEKAIGNIQKYTHLKNKVEFNELNLLQGLLLKILHRLVGYTSIWERDLRFRLKG  979

10-LibC2C2    903 --YFKHSGITERVEYW--------------------------------------------  916
                  -- F  +   E +   +                                   --------

12-Lew2C2C2   980 --EFPENHYIEEIFNFDNSKNVKYKSGQIVEKYINFYKELYKDNVEKRSIY--------- 1028

10-LibC2C2    917 ----------------GDNRLKSIKK-----------------LDTFLKKEGLFVSE-   940
                  ---------------- D ++K +K+------------------             +

12-Lew2C2C2  1029 ----------------SDKKVKKLKQ---------------------------EKKD  1042

10-LibC2C2    941 -----KNARNHIAHLNYLSLK---SECTLLYLSERLRE-IFKYDRKLKNAVSKSLIDILD  991
                  -----  RN+IAH NY+    ---   +LL + E LR+-+  YDRKLKNA+ KS++DIL

12-Lew2C2C2  1043 -----LYIRNYIAHFNYIPHA---E-ISLLEVLENLRK-LLSYDRKLKNAIMKSIVDILK 1092

10-LibC2C2    992 RHGMSVVFA---------------------------------NLKENKHRLVIKS------ 1013
                  +G     F  ---------------------------------   ++ I++------

12-Lew2C2C2  1093 EYGFVATFK---------------------------------IGADKKIEIQT------ 1112

10-LibC2C2   1014 ------------------------------LEPKKLRHLGGKKIDGGYIE--TNQVSEEY 1041
                  ------------------------------LE +K+ HL   K         --T++ SEE

12-Lew2C2C2  1113 ------------------------------LESEKIVHLKNLKKKKLM----TDRNSEEL 1138

10-LibC2C2   1042 CGIVKRLLEM-------------------------------------------- 1051
                  C +VK + E  --------------------------------------------

12-Lew2C2C2  1139 CELVKVMFEYKA----------------------------------------LE------ 1152
```

Fig. 67E

```
10-LibC2C2        ------------
                  ------------
12-Lew2C2C2       ------------
```

Fig. 67F

TYPE VI CRISPR ORTHOLOGS AND SYSTEMS

RELATED APPLICATIONS AND INCORPORATION BY REFERENCE

This application claims priority to U.S. Provisional 62/351,662 and 62/351,803, filed on Jun. 17, 2016, U.S. Provisional 62/376,377, filed on Aug. 17, 2016, U.S. Provisional 62/410,366, filed Oct. 19, 2016, U.S. Provisional 62/432,240, filed Dec. 9, 2016, U.S. provisional 62/471,792 filed Mar. 15, 2017, and U.S. Provisional 62/484,786 filed Apr. 12, 2017.

Reference is made to U.S. Provisional 62/471,710, filed Mar. 15, 2017 (entitled, "Novel Cas13B Orthologues CRISPR Enzymes and Systems,". Reference is further made to U.S. Provisional 62/432,553, filed Dec. 9, 2016, U.S. Provisional 62/456,645, filed Feb. 8, 2017, and U.S. Provisional 62/471,930, filed Mar. 15, 2017 (entitled "CRISPR Effector System Based Diagnostics," and U.S. Provisional 62/484,869, filed Apr. 12, 2017 (entitled "CRISPR Effector System Based Diagnostics,".

STATEMENT AS TO FEDERALLY SPONSORED RESEARCH

This invention was made with government support under grant numbers MH100706 and MH110049 awarded by the National Institutes of Health. The government has certain rights in the invention.

All documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

REFERENCE TO AN ELECTRONIC SEQUENCE LISTING

The contents of the electronic sequence listing ("BROD-2710US_ST25.txt"; Size is 1,357,511 bytes and it was created on May 3, 2022) is herein incorporated by reference in its entirety.

FIELD OF THE INVENTION

The present invention generally relates to systems, methods and compositions used for the control of gene expression involving sequence targeting, such as perturbation of gene transcripts or nucleic acid editing, that may use vector systems related to Clustered Regularly Interspaced Short Palindromic Repeats (CRISPR) and components thereof.

BACKGROUND OF THE INVENTION

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome and transcriptome engineering technologies that employ novel strategies and molecular mechanisms and are affordable, easy to set up, scalable, and amenable to targeting multiple positions within the eukaryotic genome and transcriptome. This would provide a major resource for new applications in genome engineering and biotechnology.

The CRISPR-Cas systems of bacterial and archaeal adaptive immunity show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein. Novel effector proteins associated with Class 2 CRISPR-Cas systems may be developed as powerful genome engineering tools and the prediction of putative novel effector proteins and their engineering and optimization is important.

The CRISPR-Cas adaptive immune system defends microbes against foreign genetic elements via DNA or RNA-DNA interference. Recently, the Class 2 type VI single-component CRISPR-Cas effector C2c2 (Shmakov et al. (2015) "Discovery and Functional Characterization of Diverse Class 2 CRISPR-Cas Systems"; Molecular Cell 60:1-13; doi: http://dx.doi.org/10.1016/j.molcel.2015.10.008) was characterized as an RNA-guided Rnase (Abudayyeh et al. (2016), Science, [Epub ahead of print], June 2; "C2c2 is a single-component programmable RNA-guided RNA-targeting CRISPR effector"; doi: 10.1126/science.aaf5573). It was demonstrated that C2c2 (e.g. from Leptotrichia shahii) provides robust interference against RNA phage infection. Through in vitro biochemical analysis and in vivo assays, it was shown that C2c2 can be programmed to cleave ssRNA targets carrying protospacers flanked by a 3' H (non-G) PAM. Cleavage is mediated by catalytic residues in the two conserved HEPN domains of C2c2, mutations in which generate a catalytically inactive RNA-binding protein. C2c2 is guided by a single guide and can be re-programmed to deplete specific mRNAs in vivo. It was shown that LshC2c2 can be targeted to a specific site of interest and can carry out non-specific RNase activity once primed with the cognate target RNA. These results broaden our understanding of CRISPR-Cas systems and demonstrate the possibility of harnessing C2c2 to develop a broad set of RNA-targeting tools.

C2c2 is now known as Cas13a. It will be understood that the term "C2c2" herein is used interchangeably with "Cas13a".

Citation or identification of any document in this application is not an admission that such document is available as prior art to the present invention.

SUMMARY OF THE INVENTION

There exists a pressing need for alternative and robust systems and techniques for targeting nucleic acids or polynucleotides (e.g. DNA or RNA or any hybrid or derivative thereof) with a wide array of applications, in particular in eukaryotic systems, more in particular in mammalian systems. This invention addresses this need and provides related advantages. Adding the novel RNA-targeting systems of the present application to the repertoire of genomic, transcriptomic, and epigenomic targeting technologies may transform the study and perturbation or editing of specific target sites through direct detection, analysis and manipulation, in particular in eukaryotic systems, more in particular in mammalian systems (including cells, organs, tissues, or organisms) and plant systems. To utilize the RNA-targeting systems of the present application effectively for RNA targeting without deleterious effects, it is critical to understand aspects of engineering and optimization of these RNA targeting tools.

The CRISPR-Cas13 family was discovered by computational mining of bacterial genomes for signatures of CRISPR systems (Shmakov, S. et al. Discovery and Functional Characterization of Diverse Class 2 CRISPR-Cas Systems. *Mol Cell* 60, 385-397, doi:10.1016/j.molcel.2015.10.008 (2015)), revealing the single-effector RNA-guided RNase Cas13a/C2c2 (Abudayyeh, O. O. et al. C2c2 is a single-component programmable RNA-guided RNA-targeting CRISPR effector. *Science* 353, aaf5573, doi: 10.1126/science.aaf5573 (2016)) and later the single-effector RNA-guided RNase Cas13b (Shmakov, S. et al. Diversity and evolution of class 2 CRISPR-Cas systems. *Nat Rev Microbiol* 15, 169-182, doi:10.1038/nrmicro.2016.184 (2017); Smargon, A. A. et al. Cas13b Is a Type VI-B CRISPR-Associated RNA-Guided RNase Differentially Regulated by Accessory Proteins Csx27 and Csx28. *Mol Cell* 65, 618-630 e617, doi:10.1016/j.molcel.2016.12.023 (2017)). The Class 2 type VI effector protein C2c2, also known as Cas13a, is a RNA-guided RNase that can be efficiently programmed to degrade ssRNA. C2c2 (Cas13a) achieves RNA cleavage through conserved basic residues within its two HEPN domains, in contrast to the catalytic mechanisms of other known RNases found in CRISPR-Cas systems. Mutation of the HEPN domain, such as (e.g. alanine) substitution, at any of the four predicted HEPN domain catalytic residues converted C2c2 into an inactive programmable RNA-binding protein (dC2c2, analogous to dCas9).

The programmability and specificity of the RNA-guided RNase Cas13 would make it an ideal platform for transcriptome manipulation. Applicants develop Cas13a for use as a mammalian transcript knockdown and binding tool. Cas13a from *Leptotrichia shahii* (LshCas13a) is capable of robust RNA cleavage and binding with catalytically inactive versions using programmable crRNAs and that cleavage was dependent on a directly 3'-adjacent motif known as the protospacer flanking site (PFS) with identity H (not guanine) (Abudayyeh, O. O. et al. C2c2 is a single-component programmable RNA-guided RNA-targeting CRISPR effector. *Science* 353, aaf5573, doi:10.1126/science.aaf5573 (2016)). Upon RNA cleavage, activated LshCas13a engages in "collateral activity" in which constitutive RNase activity cleaves non-targeted RNAs (Abudayyeh, O. O. et al. C2c2 is a single-component programmable RNA-guided RNA-targeting CRISPR effector. *Science* 353, aaf5573, doi: 10.1126/science.aaf5573 (2016)). This crRNA-programmed collateral activity enables in vivo programmed cell death by the bacteria to prevent spread of infection (Abudayyeh, O. O. et al. C2c2 is a single-component programmable RNA-guided RNA-targeting CRISPR effector. *Science* 353, aaf5573, doi:10.1126/science.aaf5573 (2016)) and has been applied in vitro for the specific detection of nucleic acid (Abudayyeh, O. O. et al. C2c2 is a single-component programmable RNA-guided RNA-targeting CRISPR effector. *Science* 353, aaf5573, doi:10.1126/science.aaf5573 (2016); East-Seletsky, A. et al. Two distinct RNase activities of CRISPR-C2c2 enable guide-RNA processing and RNA detection. *Nature* 538, 270-273, doi:10.1038/nature19802 (2016)). Collateral activity was recently leveraged for a highly sensitive and specific nucleic acid detection platform termed SHERLOCK that is useful for many clinical diagnoses (Gootenberg, J. S. et al. Nucleic acid detection with CRISPR-Cas13a/C2c2. *Science* 356, 438-442 (2017)).

Via screening Cas13a orthologs in bacterial and subsequent biochemical characterization, Applicants select an ortholog optimized for RNA endonuclease activity, the Cas13a from *Leptotrichia wadei* (LwaCas13a). LwaCas13a can be stably expressed in mammalian cells, retargeted to effectively knockdown both reporter and endogenous transcripts in cells, and attains levels of high levels of targeting specificity compared to RNAi without observable collateral activity. Furthermore, Applicants show that catalytically inactive LwaCas13a (dCas13a) programmably binds RNA transcripts in vivo and can be used to image transcripts in cells. By engineering a negative-feedback imaging system based upon dCas13a, the formation of stress granules can be tracked in living cells.

The ability of dC2c2 (dCas13a) to bind to specified sequences could be used in several aspects according to the invention to (i) bring effector modules to specific transcripts to modulate the function or translation, which could be used for large-scale screening, construction of synthetic regulatory circuits and other purposes; (ii) fluorescently tag specific RNAs to visualize their trafficking and/or localization; (iii) alter RNA localization through domains with affinity for specific subcellular compartments; and (iv) capture specific transcripts (through direct pull down of dC2c2 or use of dC2c2 to localize biotin ligase activity to specific transcripts) to enrich for proximal molecular partners, including RNAs and proteins.

Active C2c2 should also have many applications. An aspect of the invention involves targeting a specific transcript for destruction, as with RFP here. In addition, C2c2, once primed by the cognate target, can cleave other (non-complementary) RNA molecules in vitro and can inhibit cell growth in vivo. Biologically, this promiscuous RNase activity may reflect a programmed cell death/dormancy (PCD/ D)-based protection mechanism of the type VI CRISPR-Cas systems. Accordingly, in an aspect of the invention, it might be used to trigger PCD or dormancy in specific cells—for example, cancer cells expressing a particular transcript, neurons of a given class, cells infected by a specific pathogen, or other aberrant cells or cells the presence of which is otherwise undesirable.

The invention provides a method of modifying nucleic acid sequences associated with or at a target locus of interest, in particular in eukaryotic cells, tissues, organs, or organisms, more in particular in mammalian cells, tissues, organs, or organisms, the method comprising delivering to said locus a non-naturally occurring or engineered composition comprising a Type VI CRISPR-Cas loci effector protein and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises RNA and the effector protein is encoded by a type VI CRISPR-Cas loci. The complex can be formed in vitro or ex vivo and introduced into a cell or contacted with RNA; or can be formed in vivo.

It will be appreciated that the terms Cas enzyme, CRISPR enzyme, CRISPR protein Cas protein and CRISPR Cas are generally used interchangeably and at all points of reference herein refer by analogy to novel CRISPR effector proteins further described in this application, unless otherwise apparent, such as by specific reference to Cas9. The CRISPR effector proteins described herein are preferably C2c2 effector proteins.

The invention provides a method of targeting (such as modifying) sequences associated with or at a target locus of interest, the method comprising delivering to said sequences associated with or at the locus a non-naturally occurring or engineered composition comprising a C2c2 loci effector protein (which may be catalytically active, or alternatively catalytically inactive) and one or more nucleic acid components, wherein the C2c2 effector protein forms a complex with the one or more nucleic acid components and upon binding of the said complex to the locus of interest the effector protein induces the modification of sequences associated with or at the target locus of interest. In a preferred embodiment, the modification is the introduction of a strand break. In a preferred embodiment the C2c2 effector protein forms a complex with one nucleic acid component; advantageously an engineered or non-naturally occurring nucleic acid component. The complex can be formed in vitro or ex vivo and introduced into a cell or contacted with RNA; or can be formed in vivo. The induction of modification of sequences associated with or at the target locus of interest can be C2c2 effector protein-nucleic acid guided. In a preferred embodiment the one nucleic acid component is a CRISPR RNA (crRNA). In a preferred embodiment the one nucleic acid component is a mature crRNA or guide RNA, wherein the mature crRNA or guide RNA comprises a spacer sequence (or guide sequence) and a direct repeat sequence or derivatives thereof. In a preferred embodiment the spacer sequence or the derivative thereof comprises a seed sequence, wherein the seed sequence is critical for recognition and/or hybridization to the sequence at the target locus.

Aspects of the invention relate to C2c2 effector protein complexes having one or more non-naturally occurring or engineered or modified or optimized nucleic acid components. In a preferred embodiment the nucleic acid component of the complex may comprise a guide sequence linked to a direct repeat sequence, wherein the direct repeat sequence comprises one or more stem loops or optimized secondary structures. In certain embodiments, the direct repeat has a minimum length of 16 nts, such as at least 28 nt, and a single stem loop. In further embodiments the direct repeat has a length longer than 16 nts, preferably more than 17 nts, such as at least 28 nt, and has more than one stem loop or optimized secondary structures. In particular embodiments, the direct repeat has 25 or more nts, such as 26 nt, 27 nt, 28 nt or more, and one or more stem loop structures. In a preferred embodiment the direct repeat may be modified to comprise one or more protein-binding RNA aptamers. In a preferred embodiment, one or more aptamers may be included such as part of optimized secondary structure. Such aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

The invention provides cells comprising the type VI effector protein and/or guides and/or complexes thereof with target nucleic acids. In certain embodiments, the cell is a eukaryotic cell, including but not limited to a yeast cell, a plant cell, a mammalian cell, an animal cell, or a human cell.

The invention also provides a method of modifying a target locus of interest, in particular in eukaryotic cells, tissues, organs, or organisms, more in particular in mammalian cells, tissues, organs, or organisms, the method comprising delivering to said locus a non-naturally occurring or engineered composition comprising a C2c2 loci effector protein and one or more nucleic acid components, wherein the C2c2 effector protein forms a complex with the one or more nucleic acid components and upon binding of the said complex to the locus of interest the effector protein induces the modification of the target locus of interest. In a preferred embodiment, the modification is the introduction of a strand break. The complex can be formed in vitro or ex vivo and introduced into a cell or contacted with RNA; or can be formed in vivo.

In such methods the target locus of interest may be comprised within an RNA molecule. Also, the target locus of interest may be comprised within a DNA molecule, and in certain embodiments, within a transcribed DNA molecule. In such methods the target locus of interest may be comprised in a nucleic acid molecule in vitro.

In such methods the target locus of interest may be comprised in a nucleic acid molecule within a cell, in particular a eukaryotic cell, such as a mammalian cell or a plant cell. The mammalian cell many be a non-human primate, bovine, porcine, rodent or mouse cell. The cell may be a non-mammalian eukaryotic cell such as poultry, fish or shrimp. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The mammalian cell many be a non-human mammal, e.g., primate, bovine, ovine, porcine, canine, rodent, Leporidae such as monkey, cow, sheep, pig, dog, rabbit, rat or mouse cell. The cell may be a non-mammalian eukaryotic cell such as poultry bird (e.g., chicken), vertebrate fish (e.g., salmon) or shellfish (e.g., oyster, claim, lobster, shrimp) cell. The cell may also be a plant cell. The plant cell may be of a monocot or dicot or of a crop or grain plant such as cassava, corn, sorghum, soybean, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lactuca*; plants of the genus *Spinacia*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc.).

The invention provides a method of modifying a target locus of interest, the method comprising delivering to said locus a non-naturally occurring or engineered composition comprising a Type VI CRISPR-Cas loci effector protein and one or more nucleic acid components, wherein the effector protein forms a complex with the one or more nucleic acid components and upon binding of the said complex to the locus of interest the effector protein induces the modification of the target locus of interest. In a preferred embodiment, the modification is the introduction of a strand break.

The invention also provides a method of modifying a target locus of interest, the method comprising delivering to said locus a non-naturally occurring or engineered composition comprising a C2c2 loci effector protein and one or more nucleic acid components, wherein the C2c2 effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised in a nucleic acid molecule in vitro. In such methods the target locus of interest may be comprised in a nucleic acid molecule within a cell. Preferably, in such methods the target locus of interest may be comprised in a RNA molecule in vitro. Also preferably, in such methods the target locus of interest may be comprised in a RNA molecule within a cell. The cell may be a prokaryotic cell or a eukaryotic cell. The cell may be a mammalian cell. The cell may be a rodent cell. The cell may be a mouse cell.

In any of the described methods the target locus of interest may be a genomic or epigenomic locus of interest. In any of the described methods the complex may be delivered with multiple guides for multiplexed use. In any of the described methods more than one protein(s) may be used.

In further aspects of the invention the nucleic acid components may comprise a CRISPR RNA (crRNA) sequence. Without limitation, the Applicants hypothesize that in such instances, the pre-crRNA may comprise secondary structure that is sufficient for processing to yield the mature crRNA as well as crRNA loading onto the effector protein. By means of example and not limitation, such secondary structure may comprise, consist essentially of or consist of a stem loop within the pre-crRNA, more particularly within the direct repeat.

In any of the described methods the effector protein and nucleic acid components may be provided via one or more polynucleotide molecules encoding the protein and/or nucleic acid component(s), and wherein the one or more polynucleotide molecules are operably configured to express the protein and/or the nucleic acid component(s). The one or more polynucleotide molecules may comprise one or more regulatory elements operably configured to express the protein and/or the nucleic acid component(s). The one or more polynucleotide molecules may be comprised within one or more vectors. In any of the described methods the target locus of interest may be a genomic or epigenomic locus of interest. In any of the described methods the complex may be delivered with multiple guides for multiplexed use. In any of the described methods more than one protein(s) may be used.

Regulatory elements may comprise inducible promotors. Polynucleotides and/or vector systems may comprise inducible systems.

In any of the described methods the one or more polynucleotide molecules may be comprised in a delivery system, or the one or more vectors may be comprised in a delivery system.

In any of the described methods the non-naturally occurring or engineered composition may be delivered via liposomes, particles including nanoparticles, exosomes, microvesicles, a gene-gun or one or more viral vectors.

The invention also provides a non-naturally occurring or engineered composition which is a composition having the characteristics as discussed herein or defined in any of the herein described methods.

In certain embodiments, the invention thus provides a non-naturally occurring or engineered composition, such as particularly a composition capable of or configured to modify a target locus of interest, said composition comprising a Type VI CRISPR-Cas loci effector protein and one or more nucleic acid components, wherein the effector protein forms a complex with the one or more nucleic acid components and upon binding of the said complex to the locus of interest the effector protein induces the modification of the target locus of interest. In certain embodiments, the effector protein may be a C2c2 loci effector protein.

The invention also provides in a further aspect a non-naturally occurring or engineered composition, such as particularly a composition capable of or configured to modify a target locus of interest, said composition comprising: (a) a guide RNA molecule (or a combination of guide RNA molecules, e.g., a first guide RNA molecule and a second guide RNA molecule, such as for multiplexing) or a nucleic acid encoding the guide RNA molecule (or one or more nucleic acids encoding the combination of guide RNA molecules); (b) a Type VI CRISPR-Cas loci effector protein or a nucleic acid encoding the Type VI CRISPR-Cas loci effector protein. In certain embodiments, the effector protein may be a C2c2 loci effector protein.

The invention also provides in a further aspect a non-naturally occurring or engineered composition comprising: (a) a guide RNA molecule (or a combination of guide RNA molecules, e.g., a first guide RNA molecule and a second guide RNA molecule) or a nucleic acid encoding the guide RNA molecule (or one or more nucleic acids encoding the combination of guide RNA molecules); (b) be a C2c2 loci effector protein.

The invention also provides a vector system comprising one or more vectors, the one or more vectors comprising one or more polynucleotide molecules encoding components of a non-naturally occurring or engineered composition which is a composition having the characteristics as defined in any of the herein described methods.

The invention also provides a delivery system comprising one or more vectors or one or more polynucleotide molecules, the one or more vectors or polynucleotide molecules comprising one or more polynucleotide molecules encoding components of a non-naturally occurring or engineered composition which is a composition having the characteristics discussed herein or as defined in any of the herein described methods.

The invention also provides a non-naturally occurring or engineered composition, or one or more polynucleotides encoding components of said composition, or vector or delivery systems comprising one or more polynucleotides encoding components of said composition for use in a therapeutic method of treatment. The therapeutic method of treatment may comprise gene or transcriptome editing, or gene therapy.

The invention also provides for methods and compositions wherein one or more amino acid residues of the effector protein may be modified e.g., an engineered or non-naturally-occurring effector protein or C2c2. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of the RNA strand at the target locus of interest. In a preferred embodiment, the one or more mutations may comprise two mutations. In a preferred embodiment the one or more amino acid residues are modified in a C2c2 effector protein, e.g., an engineered or non-naturally-occurring effector protein or C2c2. In particular embodiments, the one or more modified or mutated amino acid residues are one or more of those in C2c2 corresponding to R597, H602, R1278 and H1283 (referenced to LshC2c2 amino acids), such as mutations R597A, H602A, R1278A and H1283A, or the corresponding amino acid residues in LshC2c2 orthologues.

In particular embodiments, the one or more modified of mutated amino acid residues are one or more of those in C2c2 corresponding to K2, K39, V40, E479, L514, V518, N524, G534, K535, E580, L597, V602, D630, F676, L709, 1713, R717 (HEPN), N718, H722 (HEPN), E773, P823, V828, 1879, Y880, F884, Y997, L1001, F1009, L1013, Y1093, L1099, L1111, Y1114, L1203, D1222, Y1244, L1250, L1253, K1261, I1334, L1355, L1359, R1362, Y1366, E1371, R1372, D1373, R1509 (HEPN), H1514 (HEPN), Y1543, D1544, K1546, K1548, V1551, I1558, according to C2c2 consensus numbering. In certain embodiments, the one or more modified of mutated amino acid residues are one or more of those in C2c2 corresponding to R717 and R1509. In certain embodiments, the one or more modified of mutated amino acid residues are one or more of those in C2c2 corresponding to K2, K39, K535, K1261, R1362, R1372, K1546 and K1548. In certain embodiments, said mutations result in a protein having an altered or modified activity. In certain embodiments, said mutations result in a protein having an increased activity, such as an increased specificity. In certain embodiments, said mutations result in a protein having a reduced activity, such as reduced specificity. In certain embodiments, said mutations result in a protein having no catalytic activity (i.e. "dead" C2c2). In an embodiment, said amino acid residues correspond to LshC2c2 amino acid residues, or the corresponding amino acid residues of a C2c2 protein from a different species.

In certain embodiments the one or more modified of mutated amino acid residues are one or more of those in C2c2 corresponding to M35, K36, T38, K39, I57, E65, G66, L68, N84, T86, E88, I103, N105, E123, R128, R129, K139, L152, L194, N196, K198, N201, Y222, D253, I266, F267, S280, I303, N306, R331, Y338, K389, Y390, K391, I434, K435, L458, D459, E462, L463, I478, E479, K494, R495, N498, S501, E519, N524, Y529, V530, G534, K535, Y539, T549, D551, R577, E580, A581, F582, I587, A593, L597, I601, L602, E611, E613, D630, I631, G633, K641, N646, V669, F676, S678, N695, E703, A707, I709, I713, I716, R717, H722, F740, F742, K768, I774, K778, I783, L787, S789, V792, Y796, D799, F812, N818, P820, F821, V822, P823, S824, Y829, K831, D837, L852, F858, E867, A871, L875, K877, Y880, Y881, F884, F888, F896, N901, V903, N915, K916, R918, Q920, E951, P956, Y959, Q964, I969, N994, F1000, I10001, Q1003, F10005, K1007, G1008, F1009, N1019, L1020, K1021, I1023, N1028, E1070, I1075, K1076, F1092, K1097, L1099, L1104, L1107, K1113, Y1114, E1149, E1151, I1153, L1155, L1158, D1166, L1203, D1222, G1224, I1228, R1236, K1243, Y1244, G1245, D1255, K1261, S1263, L1267, E1269, K1274, I1277, E1278, L1289, H1290, A1294, N1320, K1325, E1327, Y1328, I1334, Y1337, K1341, N1342, K1343, N1350, L1352, L1355, L1356, I1359, L1360, R1362, V1363, G1364, Y1365, I1369, R1371, D1372, F1385, E1391, D1459, K1463, K1466, R1509, N1510, I1512, A1513, H1514, N1516, Y1517, L1529, L1530, E1534, L1536, R1537, Y1543, D1544, R1545, K1546, L1547, K1548, N1549, A1550, K1553, S1554, D1557, I1558, L1559, G1563, F1568, I1612, L1651, E1652, K1655, H1658, L1659, K1663, T1673, S1677, E1678, E1679, C1681, V1684, K1685, E1689 with reference to the consensus sequence as indicated in FIG. 3, i.e. based on the alignment of *Leptotrichia wadei* F0279 ("Lew2" or "Lw2") and *Listeria* newyorkensis FSL M6-0635 (also known as Listeriaceae bacterium FSL M6-0635 ("Lib" or "LbFSL")). As indicated earlier, in certain embodiments, in the above amino acid residue list, the residues corresponding to R597, H602, R1278 and H1283 (referenced to LshC2c2 amino acids) are excluded.

In certain embodiments, the one or more modified of mutated amino acid residues are one or more conserved charged amino acid residues. In certain embodiments, said amino acid residues may be mutated to alanine.

In certain embodiments the one or more modified of mutated amino acid residues are one or more of those in C2c2 corresponding to K28, K31, R44, E162, E184, K262, E288, K357, E360, K338, R441 (HEPN), H446 (HEPN), E471, K482, K525, K558, D707, R790, K811, R833, E839, R885, E894, R895, D896, K942, R960 (HEPN), H965 (HEPN), D990, K992, K994 with reference to the consensus sequence as indicated in FIG. 2, i.e. based on the alignment of the C2c2 orthologues as indicated in FIG. 1. As indicated earlier, in certain embodiments, in the above amino acid residue list, the residues corresponding to R597, H602, R1278 and H1283 (referenced to Lsh C2c2amino acids) are excluded.

The invention also provides for the one or more mutations or the two or more mutations to be in a catalytically active domain of the effector protein. In certain embodiments, the one or more mutations or the two or more mutations may be in a catalytically active domain of the effector protein comprising a HEPN domain, or a catalytically active domain which is homologous to a HEPN domain. The effector protein may comprise one or more heterologous functional domains. The one or more heterologous functional domains may comprise one or more nuclear localization signal (NLS) domains. The one or more heterologous functional domains may comprise at least two or more NLS domains. The one or more NLS domain(s) may be positioned at or near or in proximity to a terminus of the effector protein (e.g., C2c2) and if two or more NLSs, each of the two may be positioned at or near or in proximity to a terminus of the effector protein (e.g., C2c2). The one or more heterologous functional domains may comprise one or more translational activation domains. In other embodiments the functional domain may comprise a transcriptional activation domain, for example VP64. The one or more heterologous functional domains may comprise one or more transcriptional repression domains. In certain embodiments the transcriptional repression domain comprises a KRAB domain or a SID domain (e.g. SID4X). The one or more heterologous functional domains may comprise one or more nuclease domains. In a preferred embodiment a nuclease domain comprises Fok1.

The invention also provides for the one or more heterologous functional domains to have one or more of the following activities: methylase activity, demethylase activity, translation activation activity, translation repression activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity and nucleic acid binding activity. In certain embodiments of the invention, the one or more heterologous functional domains may comprise epitope tags or reporters. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporters include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP).

At least one or more heterologous functional domains may be at or near the amino-terminus of the effector protein and/or wherein at least one or more heterologous functional domains is at or near the carboxy-terminus of the effector protein. The one or more heterologous functional domains may be fused to the effector protein. The one or more heterologous functional domains may be tethered to the effector protein. The one or more heterologous functional domains may be linked to the effector protein by a linker moiety.

The invention also provides for the effector protein comprising an effector protein from an organism from a genus comprising *Streptococcus, Campylobacter, Nitratifractor, Staphylococcus, Parvibaculum, Roseburia, Neisseria, Gluconacetobacter*, Azospirillum, Sphaerochaeta, *Lactobacillus, Eubacterium, Corynebacterium, Carnobacterium, Rhodobacter, Listeria, Paludibacter, Clostridium, Lachnospiraceae, Clostridium, Leptotrichia, Francisella, Legionella, Alicyclobacillus, Methanomethylophilus, Porphyromonas, Prevotella,* Bacteroidetes, *Helcococcus, Leptospira, Desulfovibrio,* Desulfonatronum, Opitutaceae, Tuberibacillus, *Bacillus, Brevibacillus, Methylobacterium* or *Acidaminococcus*. The effector protein may comprise a chimeric effector protein comprising a first fragment from a first effector protein ortholog and a second fragment from a second effector protein ortholog, and wherein the first and second effector protein orthologs are different. At least one of the first and second effector protein orthologs may comprise an effector protein from an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridium, Leptotrichia, Francisella, Legionella, Alicyclobacillus, Methanomethylophilus, Porphyromonas, Prevotella, Bacteroidetes, Helcococcus, Leptospira, Desulfovibrio, Desulfonatronum, Opitutaceae, Tuberibacillus, Bacillus, Brevibacillus, Methylobacterium* or *Acidaminococcus*.

In certain embodiments, the effector protein, particularly a Type VI loci effector protein, more particularly a C2c2p, may originate from, may be isolated from, or may be derived from a bacterial species belonging to the taxa alpha-proteobacteria, Bacilli, Clostridia, Fusobacteria and Bacteroidetes. In certain embodiments, the effector protein, particularly a Type VI loci effector protein, more particularly a C2c2p, may originate from, may be isolated from, or may be derived from a bacterial species belonging to a genus selected from the group consisting of Lachnospiraceae, *Clostridium, Carnobacterium, Paludibacter, Listeria, Leptotrichia*, and *Rhodobacter*. In certain embodiments, the effector protein, particularly a Type VI loci effector protein, more particularly a C2c2p may originate from, may be isolated from or may be derived from a bacterial species selected from the group consisting of *Lachnospiraceae bacterium* MA2020, *Lachnospiraceae bacterium* NK4A179, *Clostridium aminophilum* (e.g., DSM 10710), *Lachnospiraceae bacterium* NK4A144, *Carnobacterium gallinarum* (e.g., DSM 4847 strain MT44), *Paludibacter propionicigenes* (e.g., WB4), *Listeria* seeligeri (e.g., serovar ½b str. SLCC3954), *Listeria weihenstephanensis* (e.g., FSL R9-0317 c4), *Listeria* newyorkensis (e.g., strain FSL M6-0635: also "LbFSL"), *Leptotrichia wadei* (e.g., F0279: also "Lw" or "Lw2"), *Leptotrichia buccalis* (e.g., DSM 1135), *Leptotrichia* sp. Oral taxon 225 (e.g., str. F0581), *Leptotrichia* sp. Oral taxon 879 (e.g., strain F0557), *Leptotrichia shahii* (e.g., DSM 19757), *Rhodobacter capsulatus* (e.g., SB 1003, R121, or DE442). In certain preferred embodiments, the C2c2 effector protein originates from Listeriaceae bacterium (e.g. FSL M6-0635: also "LbFSL"), *Lachnospiraceae bacterium* MA2020, *Lachnospiraceae bacterium* NK4A179, *Clostridium aminophilum* (e.g., DSM 10710), *Carnobacterium gallinarum* (e.g., DSM 4847), *Paludibacter propionicigenes* (e.g., WB4), *Listeria* seeligeri (e.g., serovar ½b str. SLCC3954), *Listeria weihenstephanensis* (e.g., FSL R9-0317 c4), *Leptotrichia wadei* (e.g., F0279: also "Lw" or "Lw2"), *Leptotrichia shahii* (e.g., DSM 19757), *Rhodobacter capsulatus* (e.g., SB 1003, R121, or DE442); preferably Listeriaceae bacterium FSL M6-0635 (i.e. *Listeria* newyorkensis FSL M6-0635: "LbFSL" in FIGS. 4-7) or *Leptotrichia wadei* F0279 (also "Lw" or "Lw2").

In certain embodiments, a Type VI locus as intended herein may encode Cas1, Cas2, and the C2c2p effector protein.

In certain embodiments, the effector protein, particularly a Type VI loci effector protein, more particularly a C2c2p, such as a native C2c2p, may be about 1000 to about 1500 amino acids long, such as about 1100 to about 1400 amino acids long, e.g., about 1000 to about 1100, about 1100 to about 1200 amino acids long, or about 1200 to about 1300 amino acids long, or about 1300 to about 1400 amino acids long, or about 1400 to about 1500 amino acids long, e.g., about 1000, about 1100, about 1200, about 1300, about 1400 or about 1500 amino acids long.

In certain embodiments, the effector protein, particularly a Type VI loci effector protein, more particularly a C2c2p, comprises at least one and preferably at least two, such as more preferably exactly two, conserved RxxxxH motifs. Catalytic RxxxxH motifs are characteristic of HEPN (Higher Eukaryotes and Prokaryotes Nucleotide-binding) domains. Hence, in certain embodiments, the effector protein, particularly a Type VI loci effector protein, more particularly a C2c2p, comprises at least one and preferably at least two, such as more preferably exactly two, HEPN domains. In certain embodiments, the HEPN domains may possess RNAse activity. In other embodiments, the HEPN domains may possess DNAse activity.

In certain embodiments, Type VI loci as intended herein may comprise CRISPR repeats between 30 and 40 bp long, more typically between 35 and 39 bp long, e.g., 30, 31, 32, 33, 34, 35, 36, 37, 38, 39, or 40 bp long. In particular embodiments, the direct repeat is at least 25 nt long.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the effector protein, particularly a Type VI loci effector protein, more particularly a C2c2p, may recognize a 3' PAM. In certain embodiments, the effector protein, particularly a Type VI loci effector protein, more particularly a C2c2p, may recognize a 3' PAM which is 5' H, wherein H is A, C or U. In certain embodiments, the effector protein may be *Leptotrichia shahii* C2c2p, more preferably *Leptotrichia shahii* DSM 19757 C2c2, and the 5' PAM is a 5' H. In certain embodiments, the effector protein may be *Leptotrichia wadei* F0279 (Lw2) C2c2, and the 5'PAM is H, wherein H is C, U or A.

In certain embodiments, the CRISPR enzyme is engineered and can comprise one or more mutations that reduce or eliminate a nuclease activity. Mutations can also be made at neighboring residues, e.g., at amino acids near those indicated above that participate in the nuclease activity. In some embodiments, only one HEPN domain is inactivated, and in other embodiments, a second HEPN domain is inactivated.

In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In certain embodiments the guide RNA or mature crRNA comprises 19 nts of partial direct repeat followed by 18, 19, 20, 21, 22, 23, 24, 25, or more nt of guide sequence, such as 18-25, 19-25, 20-25, 21-25, 22-25, or 23-25 nt of guide sequence or spacer sequence. In certain embodiments, the effector protein is a C2c2 effector protein and requires at least 16 nt of guide sequence to achieve detectable DNA cleavage and a minimum of 17 nt of guide sequence to achieve efficient DNA cleavage in vitro. In particular embodiments, the effector protein is a C2c2 protein and requires at least 19 nt of guide sequence to achieve detectable RNA cleavage. In certain embodiments, the direct repeat sequence is located upstream (i.e., 5') from the guide sequence or spacer sequence. In a preferred embodiment the seed sequence (i.e. the sequence essential critical for recognition and/or hybridization to the sequence at the target locus) of the C2c2 guide RNA is approximately within the first 5 nt on the 5' end of the guide sequence or spacer sequence.

In preferred embodiments of the invention, the mature crRNA comprises a stem loop or an optimized stem loop structure or an optimized secondary structure. In preferred embodiments the mature crRNA comprises a stem loop or an optimized stem loop structure in the direct repeat sequence, wherein the stem loop or optimized stem loop structure is important for cleavage activity. In certain embodiments, the mature crRNA preferably comprises a single stem loop. In certain embodiments, the direct repeat sequence preferably comprises a single stem loop. In certain embodiments, the cleavage activity of the effector protein complex is modified by introducing mutations that affect the stem loop RNA duplex structure. In preferred embodiments, mutations which maintain the RNA duplex of the stem loop may be introduced, whereby the cleavage activity of the effector protein complex is maintained. In other preferred embodiments, mutations which disrupt the RNA duplex structure of the stem loop may be introduced, whereby the cleavage activity of the effector protein complex is completely abolished.

In particular embodiments, the C2c2 protein is an LshC2c2 effector protein and the mature crRNA comprises a stem loop or an optimized stem loop structure. In particular embodiments, the direct repeat of the crRNA comprises at least 25 nucleotides comprising a stem loop. In particular embodiments, the the stem is amenable to individual base swaps but activity is disrupted by most secondary structure changes or truncation of the crRNA. Examples of disrupting mutations include swapping of more than two of the stem nucleotides, addition of a non-pairing nucleotide in the stem, shortening of the stem (by removal of one of the pairing nucleotides) or extending the stem (by addition of one set of pairing nucleotides). However, the crRNA may be amenable to 5' and/or 3' extensions to include non-functional RNA sequences as envisaged for particular applications described herein.

The invention also provides for the nucleotide sequence encoding the effector protein being codon optimized for expression in a eukaryote or eukaryotic cell in any of the herein described methods or compositions. In an embodiment of the invention, the codon optimized nucleotide sequence encoding the effector protein encodes any C2c2 discussed herein and is codon optimized for operability in a eukaryotic cell or organism, e.g., such cell or organism as elsewhere herein mentioned, for instance, without limitation, a yeast cell, or a mammalian cell or organism, including a mouse cell, a rat cell, and a human cell or non-human eukaryote organism, e.g., plant.

In certain embodiments of the invention, at least one nuclear localization signal (NLS) is attached to the nucleic acid sequences encoding the C2c2 effector proteins. In preferred embodiments at least one or more C-terminal or N-terminal NLSs are attached (and hence nucleic acid molecule(s) coding for the C2c2 effector protein can include coding for NLS(s) so that the expressed product has the NLS(s) attached or connected). In certain embodiments of the invention, at least one nuclear export signal (NES) is attached to the nucleic acid sequences encoding the C2c2 effector proteins. In preferred embodiments at least one or more C-terminal or N-terminal NESs are attached (and hence nucleic acid molecule(s) coding for the C2c2 effector protein can include coding for NES(s) so that the expressed product has the NES(s) attached or connected). In a preferred embodiment a C-terminal and/or N-terminal NLS or NES is attached for optimal expression and nuclear targeting in eukaryotic cells, preferably human cells. In a preferred embodiment, the codon optimized effector protein is C2c2 and the spacer length of the guide RNA is from 15 to 35 nt. In certain embodiments, the spacer length of the guide RNA is at least 16 nucleotides, such as at least 17 nucleotides, preferably at least 18 nt, such as preferably at least 19 nt, at least 20 nt, at least 21 nt, or at least 22 nt. In certain embodiments, the spacer length is from 15 to 17 nt, from 17 to 20 nt, from 20 to 24 nt, eg. 20, 21, 22, 23, or 24 nt, from 23 to 25 nt, e.g., 23, 24, or 25 nt, from 24 to 27 nt, from 27-30 nt, from 30-35 nt, or 35 nt or longer. In certain embodiments of the invention, the codon optimized effector protein is C2c2 and the direct repeat length of the guide RNA is at least 16 nucleotides. In certain embodiments, the codon optimized effector protein is C2c2 and the direct repeat length of the guide RNA is from 16 to 20 nt, e.g., 16, 17, 18, 19, or 20 nucleotides. In certain preferred embodiments, the direct repeat length of the guide RNA is 19 nucleotides.

The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

In a further aspect, the invention provides a eukaryotic cell comprising a nucleotide sequence encoding the CRISPR system described herein which ensures the generation of a modified target locus of interest, wherein the target locus of interest is modified according to in any of the herein described methods. A further aspect provides a cell line of said cell. Another aspect provides a multicellular organism comprising one or more said cells.

In certain embodiments, the modification of the target locus of interest may result in: the eukaryotic cell comprising altered (protein) expression of at least one gene product; the eukaryotic cell comprising altered (protein) expression of at least one gene product, wherein the (protein) expression of the at least one gene product is increased; the eukaryotic cell comprising altered (protein) expression of at least one gene product, wherein the (protein) expression of the at least one gene product is decreased; or the eukaryotic cell comprising an edited transcriptome.

In certain embodiments, the eukaryotic cell may be a mammalian cell or a human cell.

In further embodiments, the non-naturally occurring or engineered compositions, the vector systems, or the delivery systems as described in the present specification may be used for RNA sequence-specific interference, RNA sequence specific modulation of expression (including isoform specific expression), stability, localization, functionality (e.g. ribosomal RNAs or miRNAs), etc.; or multiplexing of such processes.

In further embodiments, the the non-naturally occurring or engineered compositions, the vector systems, or the delivery systems as described in the present specification may be used for RNA detection and/or quantification in a sample, such as a biological sample. In certain embodiments, RNA detection is in a cell. In an embodiment, the invention provides a method of detecting a target RNA in a sample, comprising (a) incubating the sample with i) a Type VI CRISPR-Cas effector protein capable of cleaving RNA, ii) a guide RNA capable of hybridizing to the target RNA, and iii) an RNA-based cleavage inducible reporter capable of being non-specifically and detectably cleaved by the effector protein, (b) detecting said target RNA based on the signal generated by cleavage of said RNA-based cleavage inducible reporter.

In an embodiment the Type VI CRISPR-Cas effector protein is a C2c2 effector protein. In an embodiment, the RNA-based cleavage inducible reporter construct comprises a fluorochrome and a quencher. In certain embodiments, the sample comprises a cell-free biological sample. In other embodiments, the sample comprises or a cellular sample, for example, without limitation a plant cell, or an animal cell. In an embodiment of the invention, the target RNA comprises a pathogen RNA, including, but not limited to a target RNA from a virus, bacteria, fungus, or parasite. In an embodiment, the guide RNA is designed to detect a target RNA which comprises a single nucleotide polymorphism or a splice variant of an RNA transcript. In an embodiment, the guide RNA comprises one or more mismatched nucleotides with the target RNA. In certain embodiments, the guide RNA hybridizes to aa target molecule that is diagnostic for a disease state, such as, but not limited to, cancer, or an immune disease.

The invention provides a ribonucleic acid (RNA) detection system, comprising a) a Type VI CRISPR-Cas effector protein capable of cleaving RNA, b) a guide RNA capable of binding to a target RNA, and c) an RNA-based cleavage inducible reporter capable of being non-specifically and detectably cleaved by the effector protein. Further, the invention provides a kit for RNA detection, which comprises a) a Type VI CRISPR-Cas effector protein capable of cleaving RNA, and b) an RNA-based cleavage inducible reporter capable of being non-specifically and detectably cleaved by the effector protein. In certain embodiments, the RNA-based cleavage inducible reporter construct comprises a fluorochrome and a quencher.

In further embodiments, the the non-naturally occurring or engineered compositions, the vector systems, or the delivery systems as described in the present specification may be used for generating disease models and/or screening systems.

In further embodiments, the non-naturally occurring or engineered compositions, the vector systems, or the delivery systems as described in the present specification may be used for: site-specific transcriptome editing or perturbation; nucleic acid sequence-specific interference; or multiplexed genome engineering.

Also provided is a gene product from the cell, the cell line, or the organism as described herein. In certain embodiments, the amount of gene product expressed may be greater than or less than the amount of gene product from a cell that does not have altered expression or edited genome. In certain embodiments, the gene product may be altered in comparison with the gene product from a cell that does not have altered expression or edited genome.

These and other embodiments are disclosed or are obvious from and encompassed by, the following Detailed Description.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1A-1D. Cellular localization of C2c2 orthologues. (A) HEK293 cells were transfected with different C2c2 orthologues fused to mCherry with or without nuclear localization signal (NLS) or nuclear export signal (NES). (B) NES fusion of *Leptotrichia wadei* F0279 C2c2 (B1) and *Lachnospiraceae bacterium* NK4A179 C2c2 (B2) locates in the cytoplasm. (C) NLS fusion of *Leptotrichia wadei* F0279 C2c2 (C1), *Lachnospiraceae bacterium* NK4A179 C2c2 (C2), and *Leptotrichia shahii* C2c2 (C3) locates in the nucleus and variably in the nucleolus. (C) *Leptotrichia wadei* F0279 C2c2 (D1), *Lachnospiraceae bacterium* NK4A179 C2c2 (D2), and *Leptotrichia shahii* C2c2 (D3) without fusion to NLS or NES variably locates in the nucleus and cytoplasm. (D) Schematic of the four mammalian LwaCas13a constructs evaluated (left) and imaging showing the localization and expression of each of the designs (right).

FIG. 2A-2C. Assay for evaluation of C2c2 knockdown efficiency in mammalian cells. (A) Schematic of the dual luciferase reporter scheme used to determine knockdown efficiency of C2c2. Cells were transfected with different plasmids: a plasmid encoding *Gaussia* luciferase (Gluc) and Cypridina luciferase (Cluc); a plasmid encoding C2c2 (with or without NLS or NES); and a plasmid encoding a gRNA targeting *Gaussia* luciferase. Knockdown efficiency of Gluc is determined based on the ratio of Gluc and Cluc. (B) positions of different gRNAs targeting *Gaussia* luciferase mRNA. (C) Assay for evaluation of C2c2 knockdown efficiency in mammalian cells. Cells were transfected with different plasmids: a plasmid encoding EGFP; a plasmid encoding C2c2 (with or without NLS or NES); and a plasmid encoding a gRNA targeting EGFP. Knockdown efficiency of EGFP is determined by flow cytometry.

(Guide 4) ggtcttgtagttgccgtcgtccttgaag (SEQ ID NO: 10); (Guide 5) tactccagcttgtgccccaggatgttgc (SEQ ID NO: 11); (Guide 6) cacgctgccgtcctcgatgttgtggcgg (SEQ ID NO: 12); (Guide 7) tctttgctcagggcggactgggtgctca (SEQ ID NO: 13); (Guide 8) gacttgtacagctcgtccatgccgagag (SEQ ID NO: 14); and (Guide NT) tagattgctgttctaccaagtaatccat (SEQ ID NO: 6).

FIG. 6A-6E. Engineering and optimization of LwaCas13a for mammalian knockdown. (A) Knockdown of Gluc transcript by LwCas13a using a variety of guides transfected in A375s cells.: (B) Knockdown of *Gaussia* luciferase (Gluc) using engineered variants of LwaCas13a. (C) Knockdown of *Gaussia* luciferase (Gluc) by LwaCas13a and Gluc crRNA 1 spacers of varying lengths. (D) Knockdown of KRAS transcript by LwaCas13a using a variety of guides. (E) Knockdown of PPIB transcript by LwaCas13a using a variety of guides.

Figure 7:
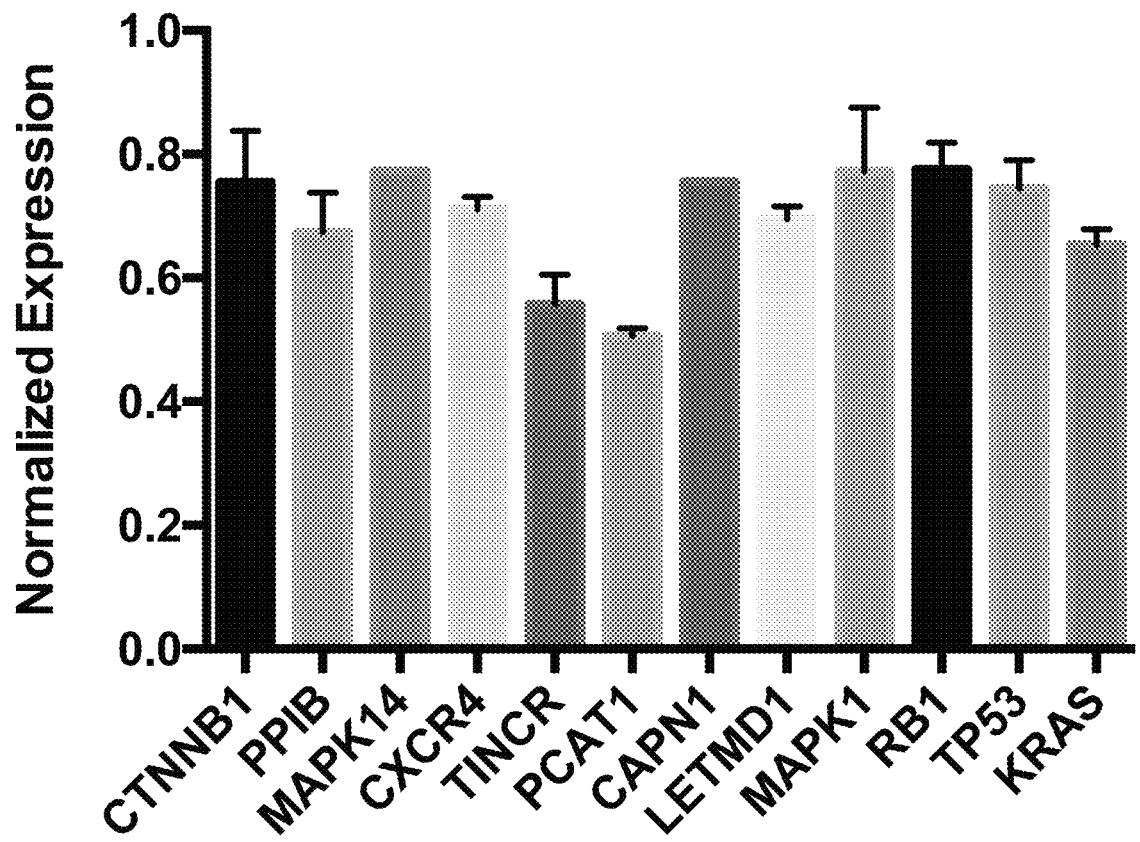

FIG. 7. Normalized protein expression of target genes with gRNAs directed against the respective target genes and with C2c2 *Leptotrichia wadei* F0279 fused with NES. gRNAs for respective target genes are: ctgctgccacagaccgagaggcttaaaa (CTNNB1) (SEQ ID NO: 15); tccttgattacacgatggaatttgctgt (PPIB) (SEQ ID NO: 16); tcaaggtgggggtcacaggagaagccaaa (mAPK14) (SEQ ID NO: 17); atgataatgcaatagcaggacaggatga (CXCR4) (SEQ ID NO: 18); gcgtgagccaccgcgcctggccggctgt (TINCR) (SEQ ID NO: 19); ccagctgcagatgctgcagttttttggcg (PCAT1) (SEQ ID NO: 20); ctggaaatggaagatgccggcatagcca (CAPN1) (SEQ ID NO: 21); gatgacacctcacacggaccaccctag (LETMDI) (SEQ ID NO: 22); taatactgctccagatatgggtgggcca (MAPK14) (SEQ ID NO: 23); catgaagaccgagttatagaatactata (RB1) (SEQ ID NO: 24); ggtgaaatattctccatccagtggtttc (TP53) (SEQ ID NO: 25); and aatttctcgaactaatgtatagaaggca (KRAS) (SEQ ID NO: 26).

Figure 8:
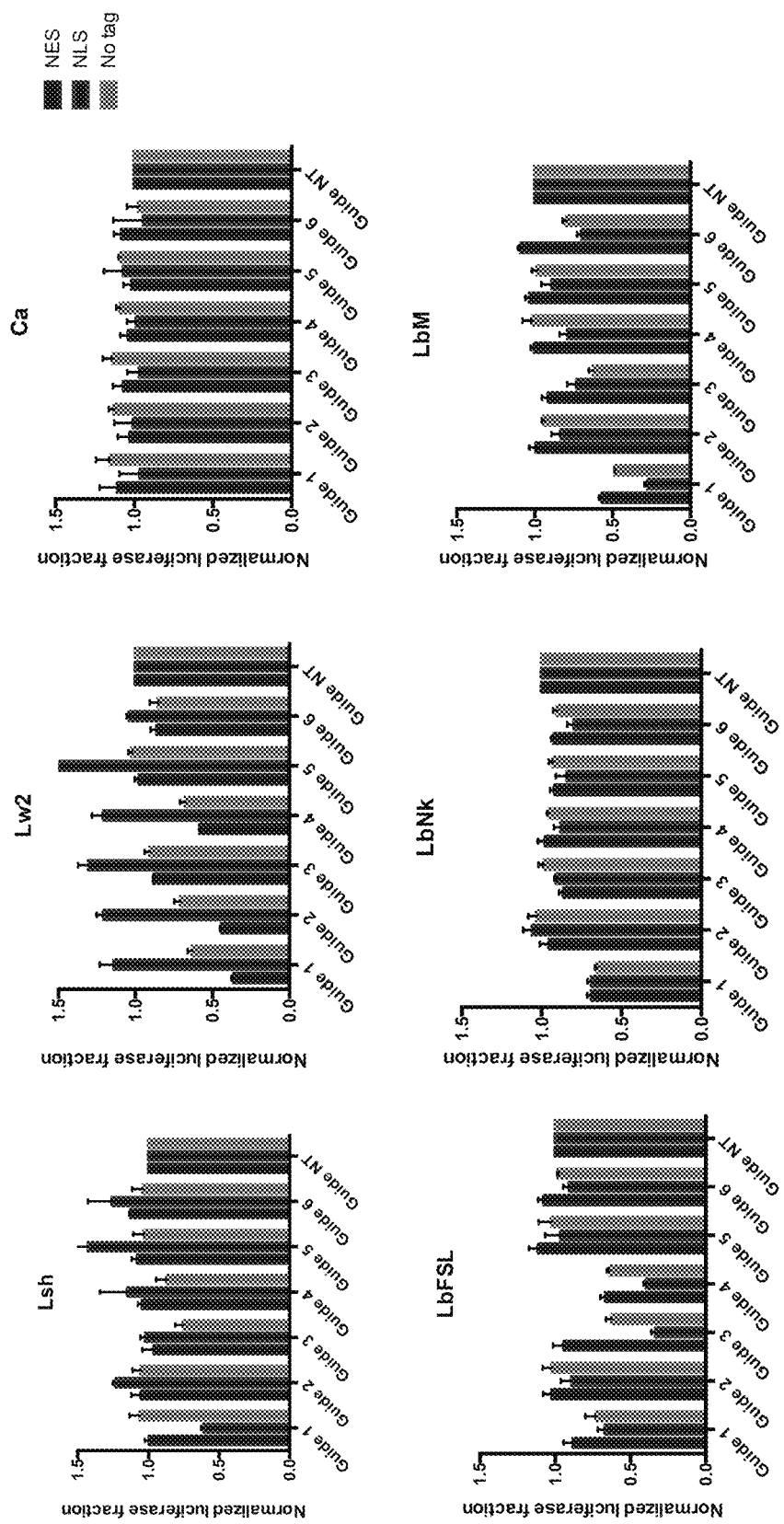

FIG. 8. Normalized protein expression of luciferase with different gRNAs directed against Gluc and with C2c2 orthologues fused with NLS, NES, or no tag. C2c2 orthologues are *Leptotrichia shahii* (Lsh), *Leptotrichia wadei* F0279 (Lw2), *Clostridium aminophilum* (Ca), *Listeria* newyorkensis FSL M6-0635 (LbFSL), *Lachnospiraceae bacterium* NK4A179 (LbNk), and *Lachnospiraceae bacterium* MA2020 (LbM).

Figure 9:
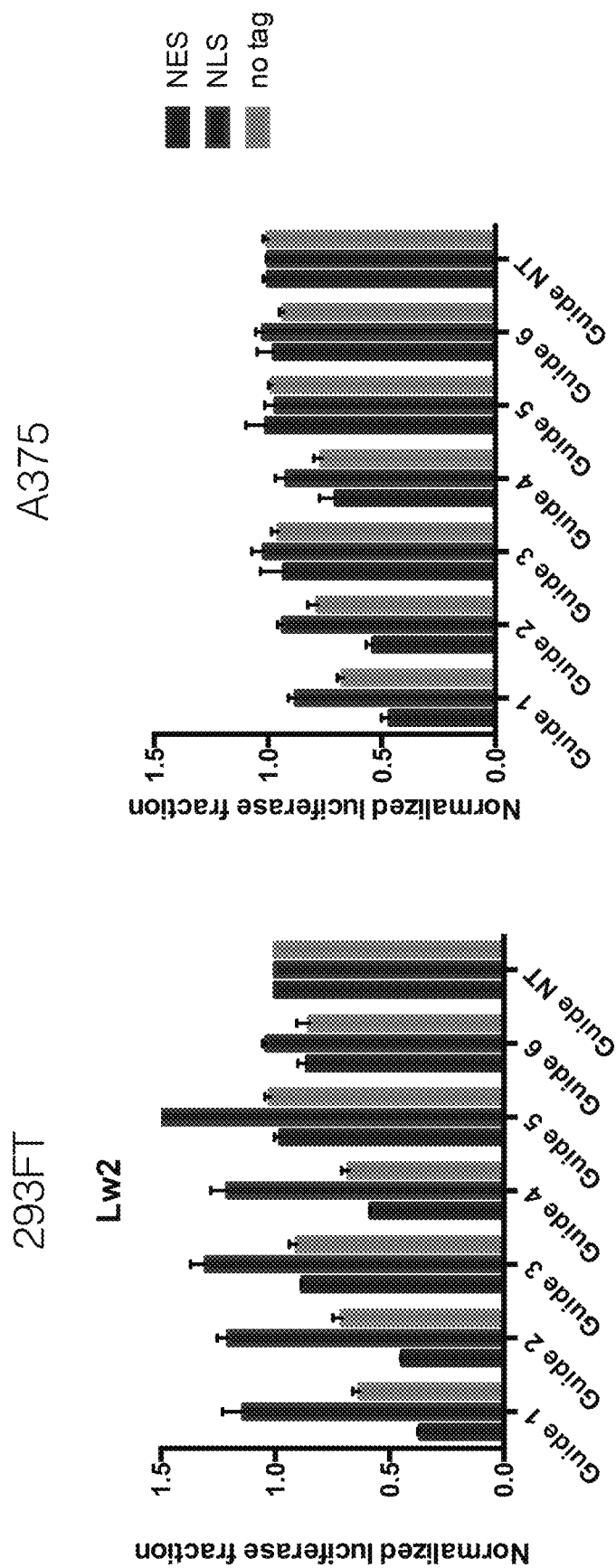

FIG. 9. Lw2 functions in multiple cell lines. Normalized luciferase activity is shown for 293FT cells.

Figure 10A:
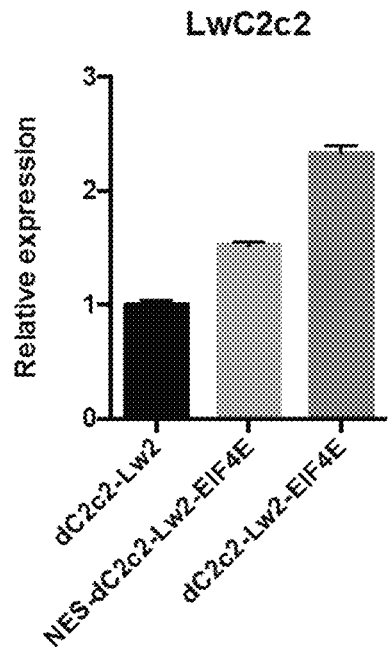
Figure 10B:
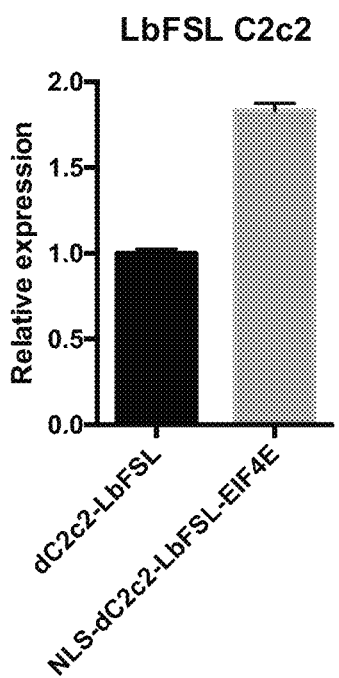

FIG. 10A-10B. Relative protein expression of luciferase with gRNA directed against Gluc and with catalytically inactivated C2c2 orthologues. (A) dC2c2 *Leptotrichia wadei* (LwC2c2) was fused to a EIF4E, EIF4E and NES, or no tag. (B) dC2c2 *Listeria* newyorkensis FSL M6-0635 (LbFSL) was fused to a NLS and EIF4E or no tag.

Figure 11A:
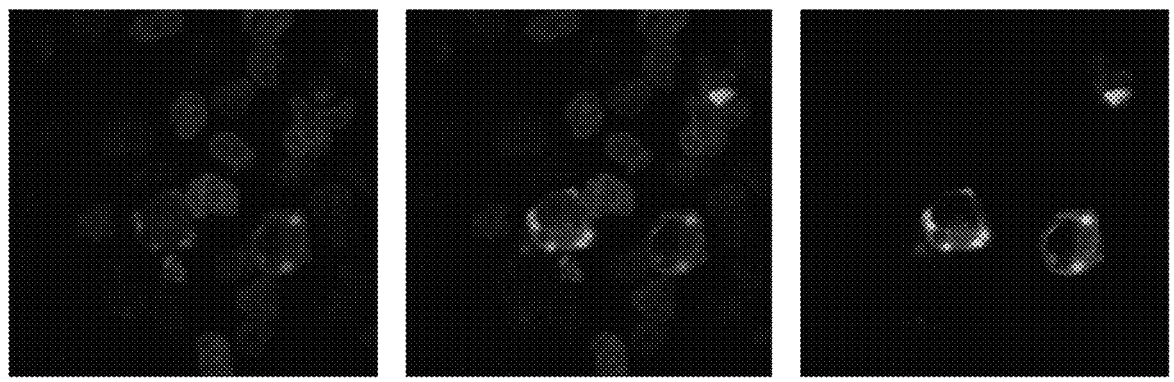
Figure 11B:
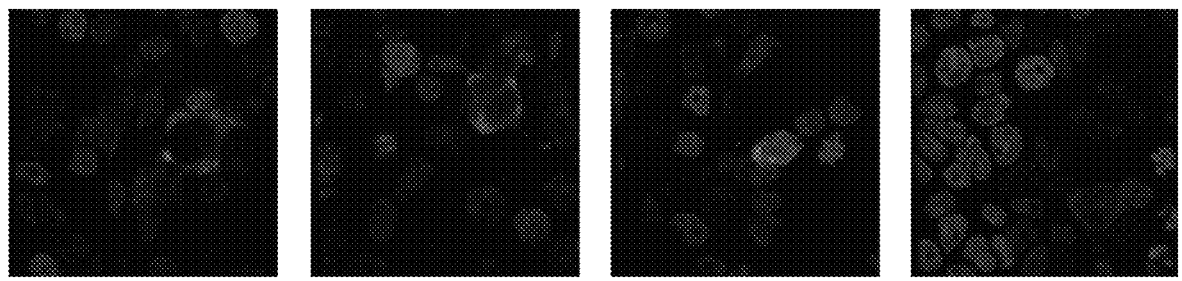
Figure 11C:
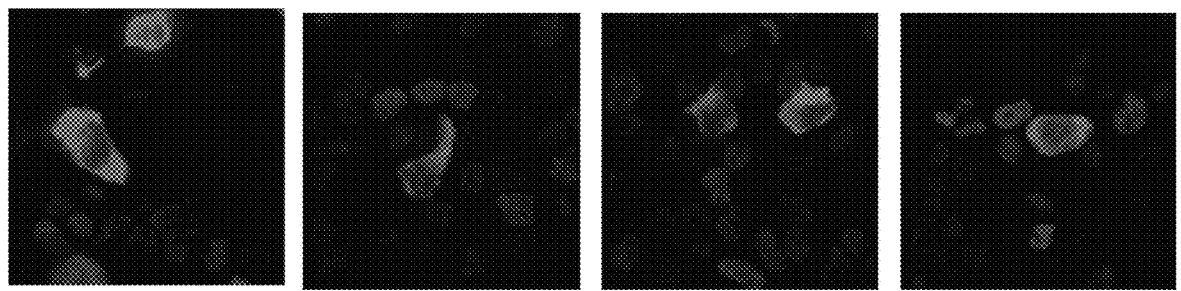

FIG. 11A-11C. Cellular localization of *Leptotrichia wadei* C2c2 targeting beta actin localizes to stress granules upon treatment of cells with NaAsO$_2$.

Figure 12:
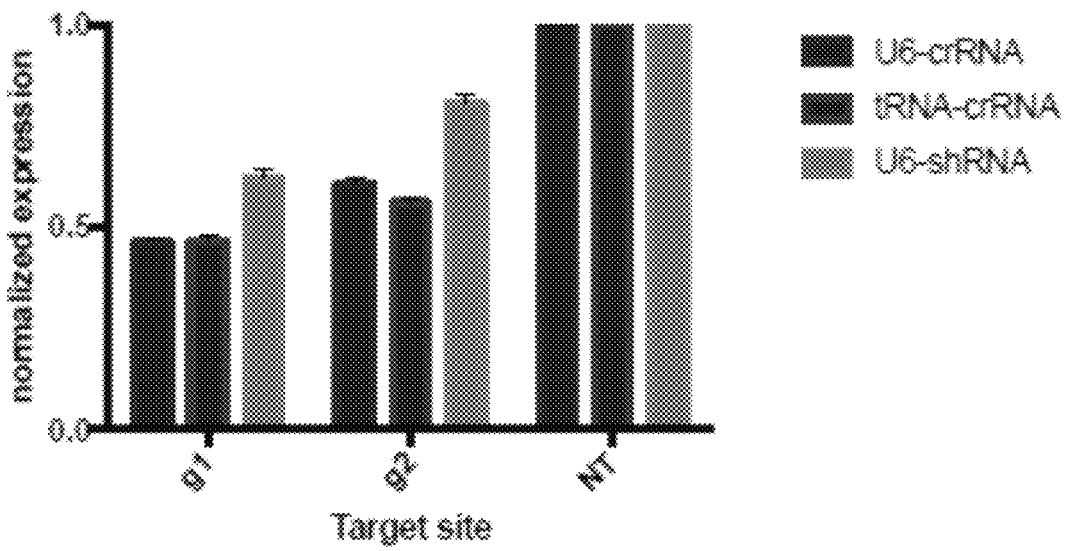

FIG. 12. RNA knockdown in mammalian cells. C2c2 outperforms shRNA at two target sites.

Figure 13:
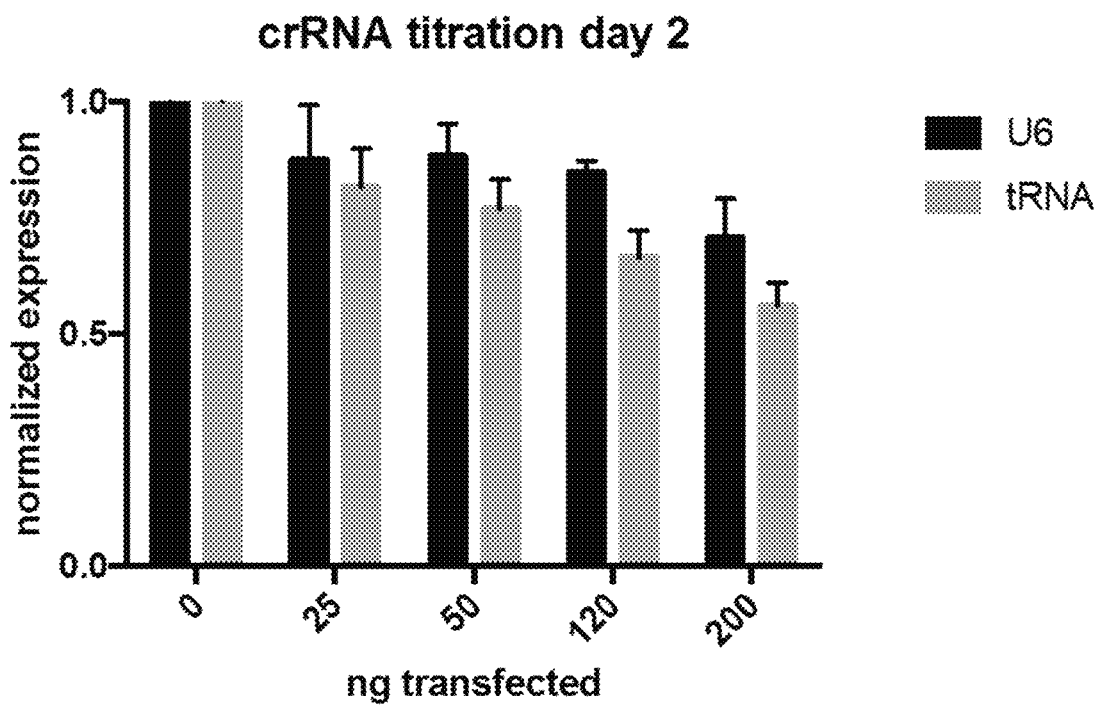

FIG. 13. Increasing crRNA transfection amount increases knockdown.

Figure 14:
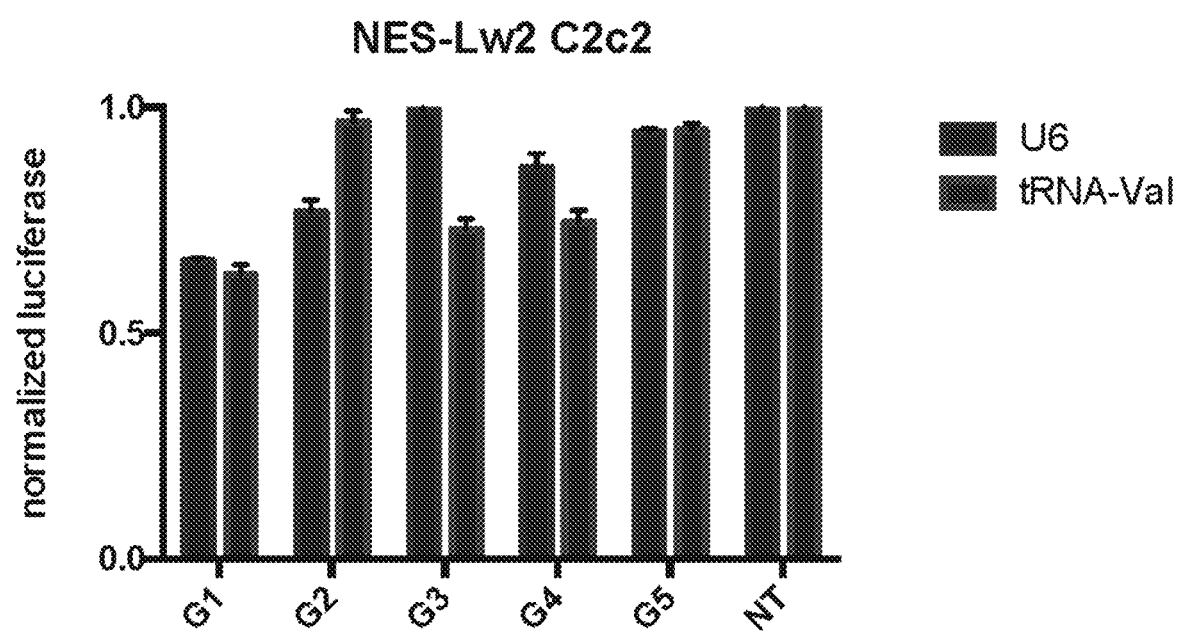

FIG. 14. Lw2C2c2 with NES (NES-Lw2C2c2) effectively cleaves RNA of tRNA and U6 knockdown.

Figure 15A:
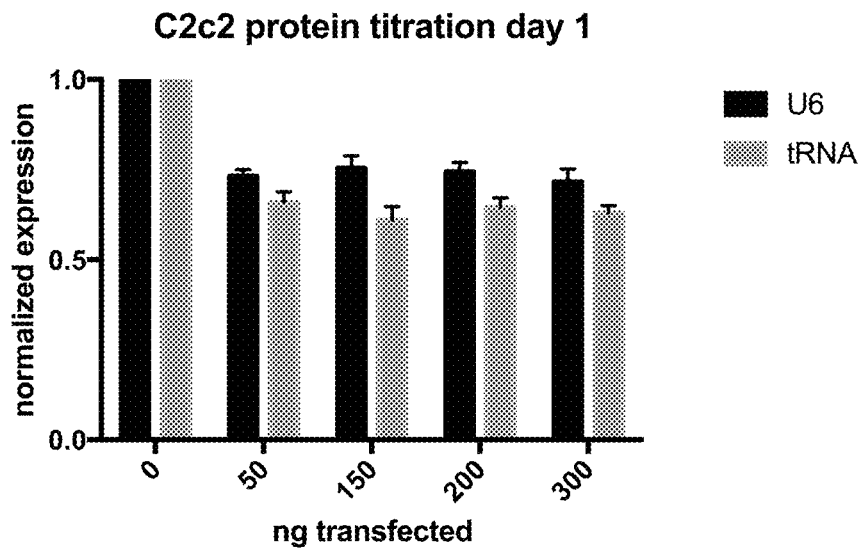
Figure 15B:
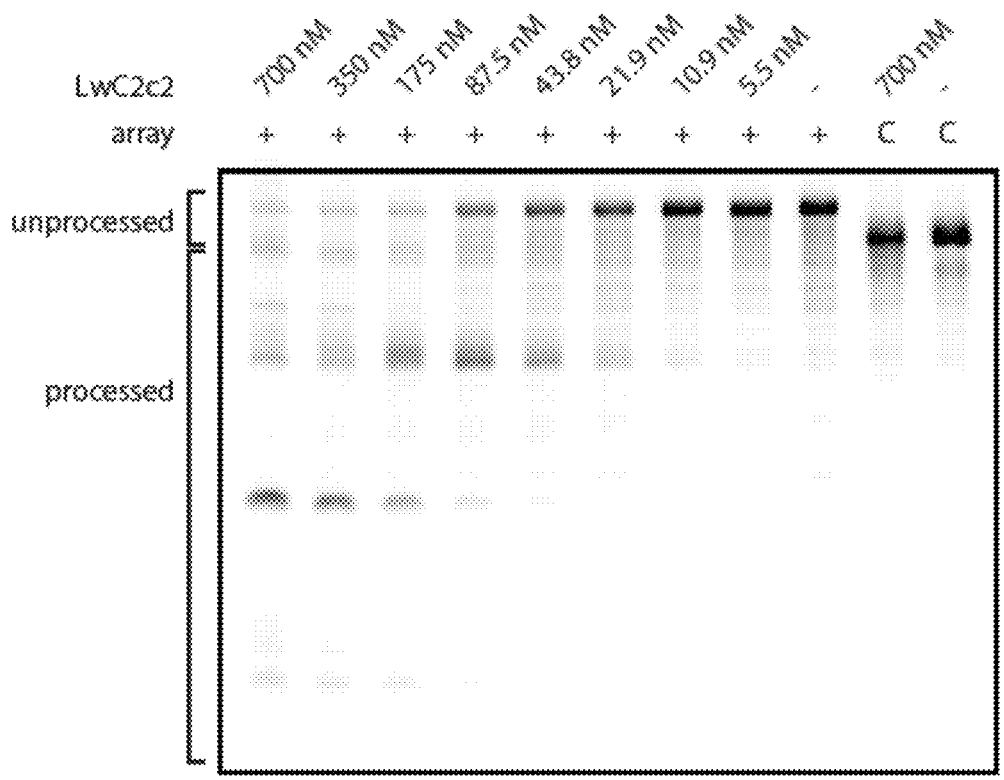

FIG. 15A-15B. (A) Protein transfection amount saturates knockdown. (B) Knockdown of Gluc transcript with Gluc crRNA 1 and varying amounts of transfected LwaCas13a plasmid.

Figure 16:
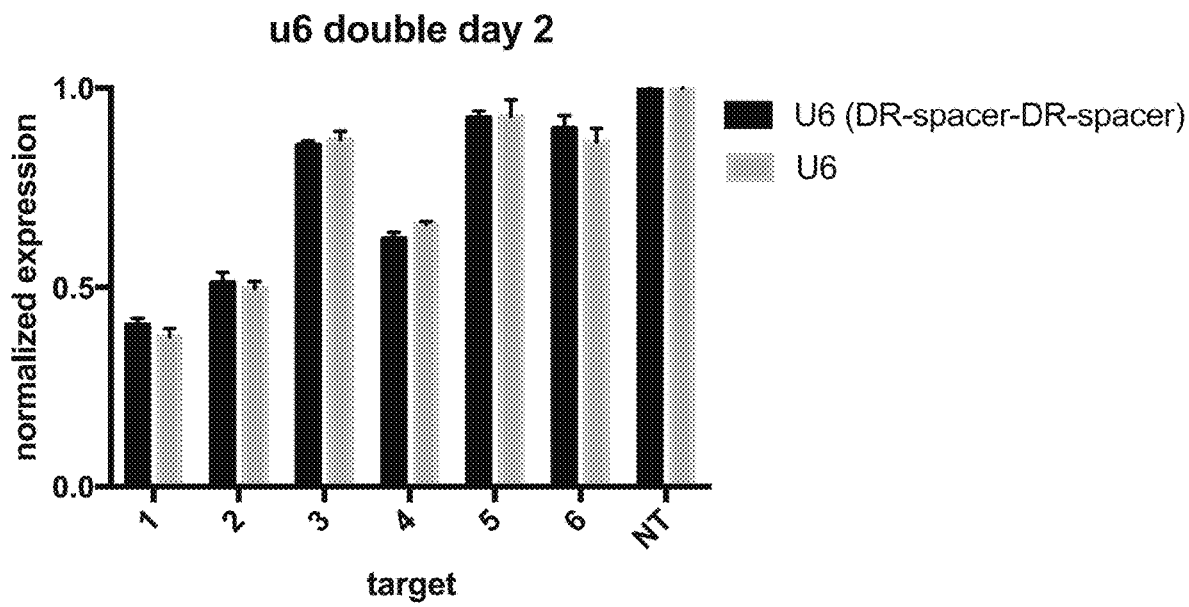

FIG. 16. U6-driven DR-spacer-DR-spacer targeting constructs.

Figure 17:
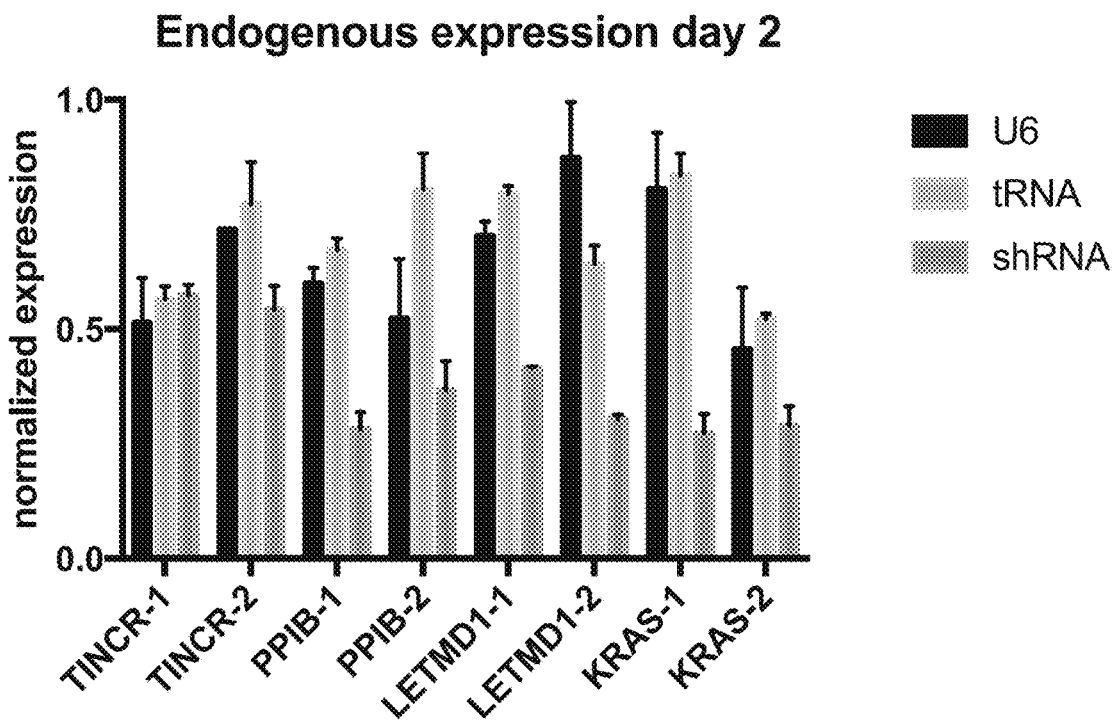

FIG. 17. Optimized shRNA is outperformed by C2c2 for corresponding targets on endogenous genes.

FIG. 18. dLw2C2c2-EIF4E fusion can upregulate translation of three genes; Protein levels as measured by band intensity on western blot.

FIG. 19. Knock-down of individual transcripts. Lw2 shows less variability and higher specificity.

Figure 20:
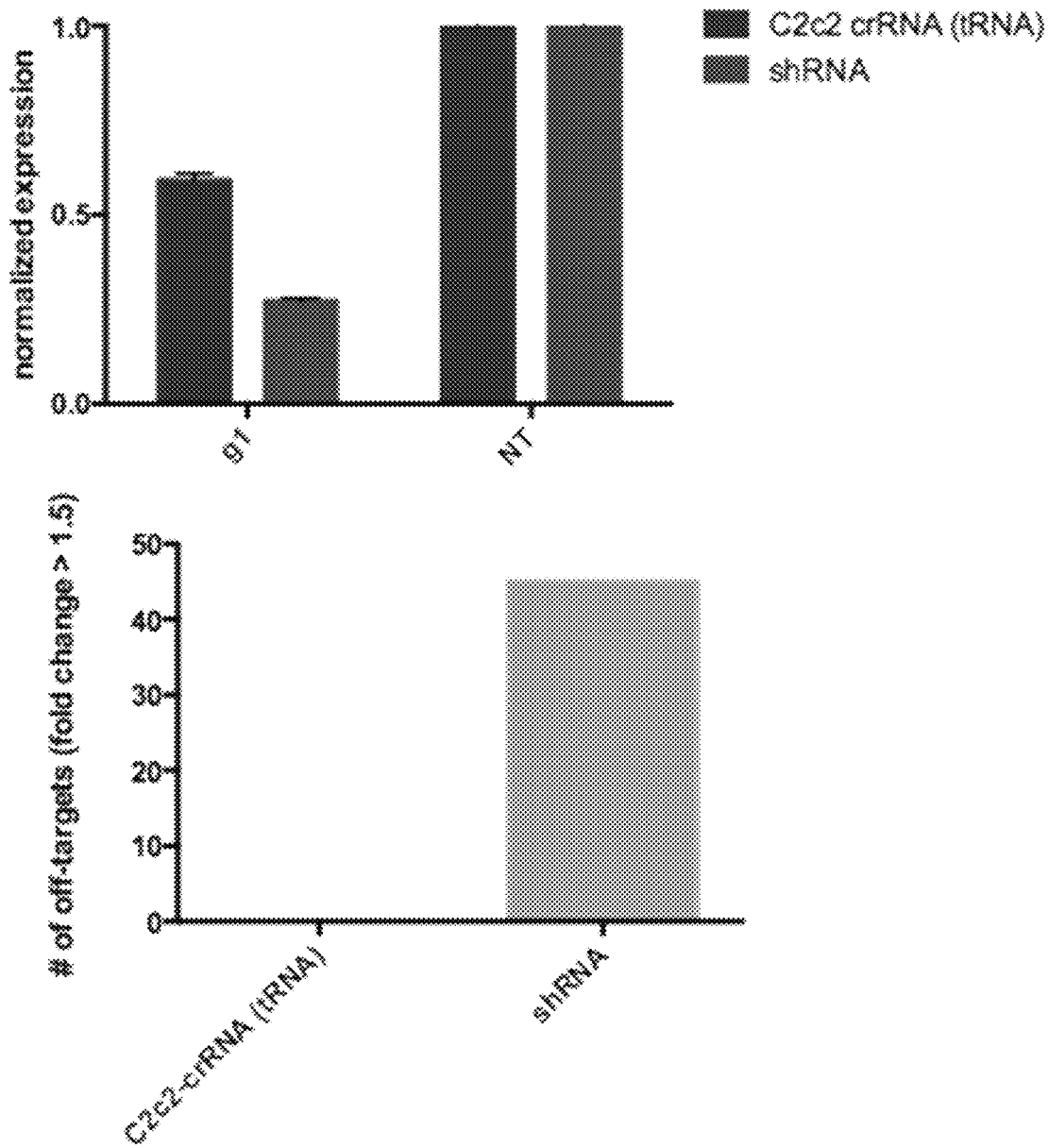

FIG. 20. RNA knockdown in mammalian cells.

Figure 21:
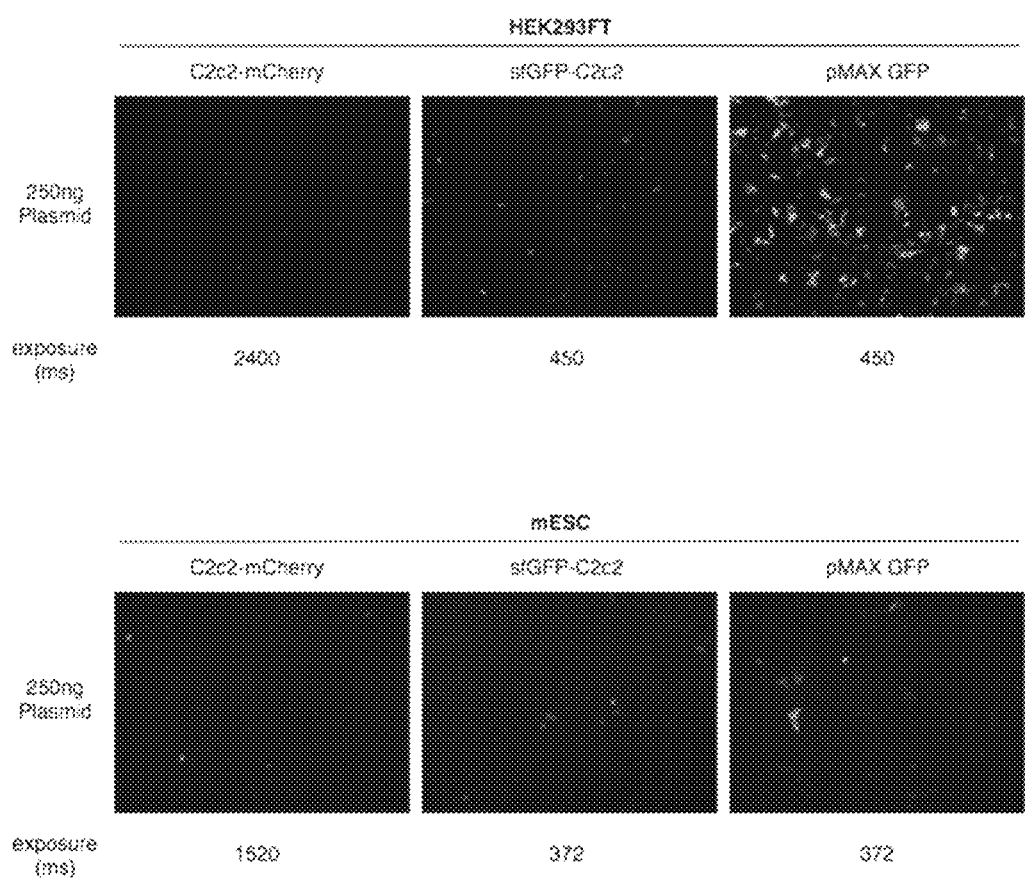

FIG. 21. Imaging is improved by a superfolding derivative of GFP (sfGFP). C2c2-mCherry and sfGFP-C2c2 fusion proteins are compared in HEK293FT cells and mouse embryonic stem cells (mESC).

Figure 22A:
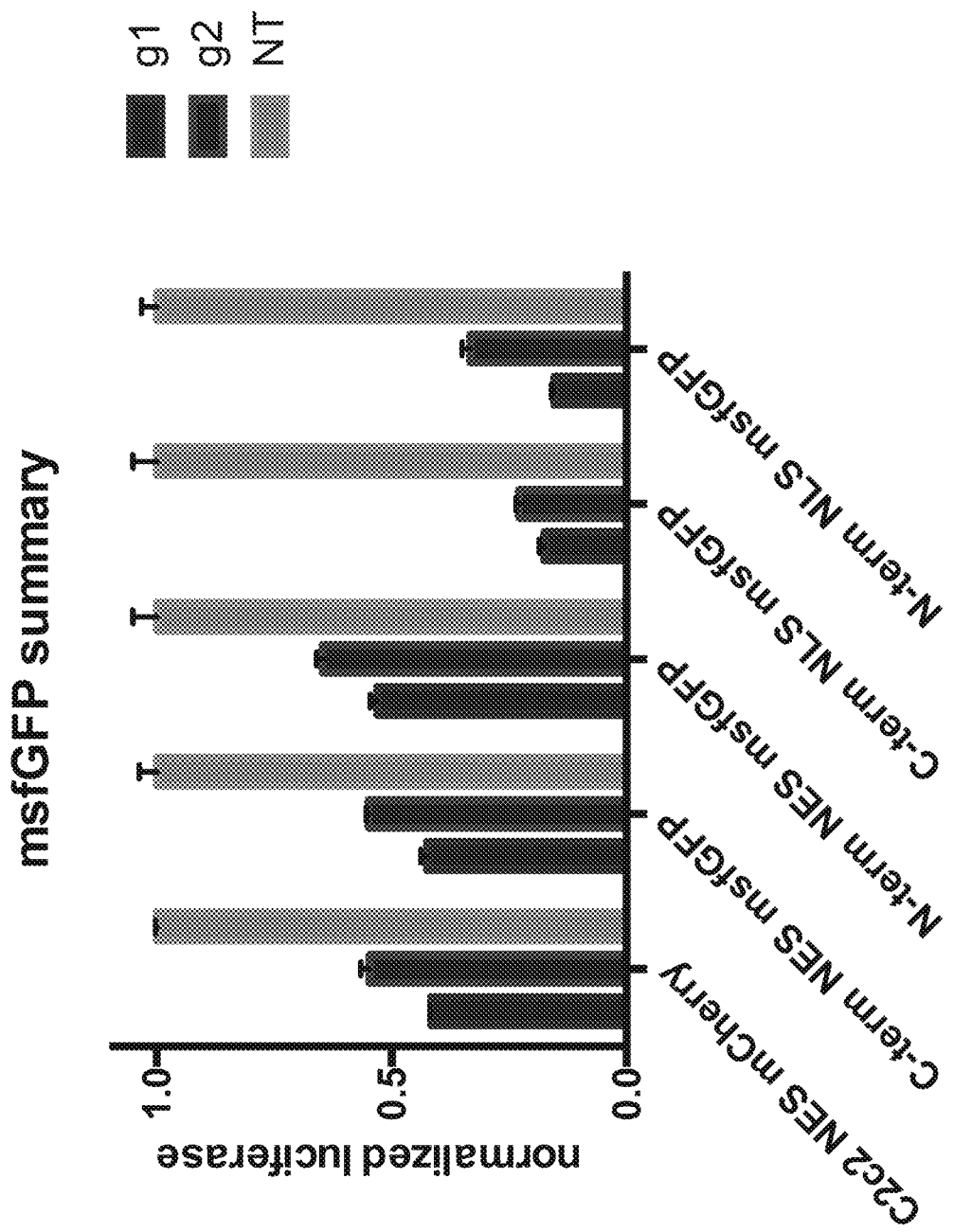

FIG. 22A. msfGFP-C2c2 improves knockdown. Luciferase knockdown by various fusion proteins of C2c2 with mCherry or msfGFP, further including an NLS or NES, are depicted.

Figure 22B:
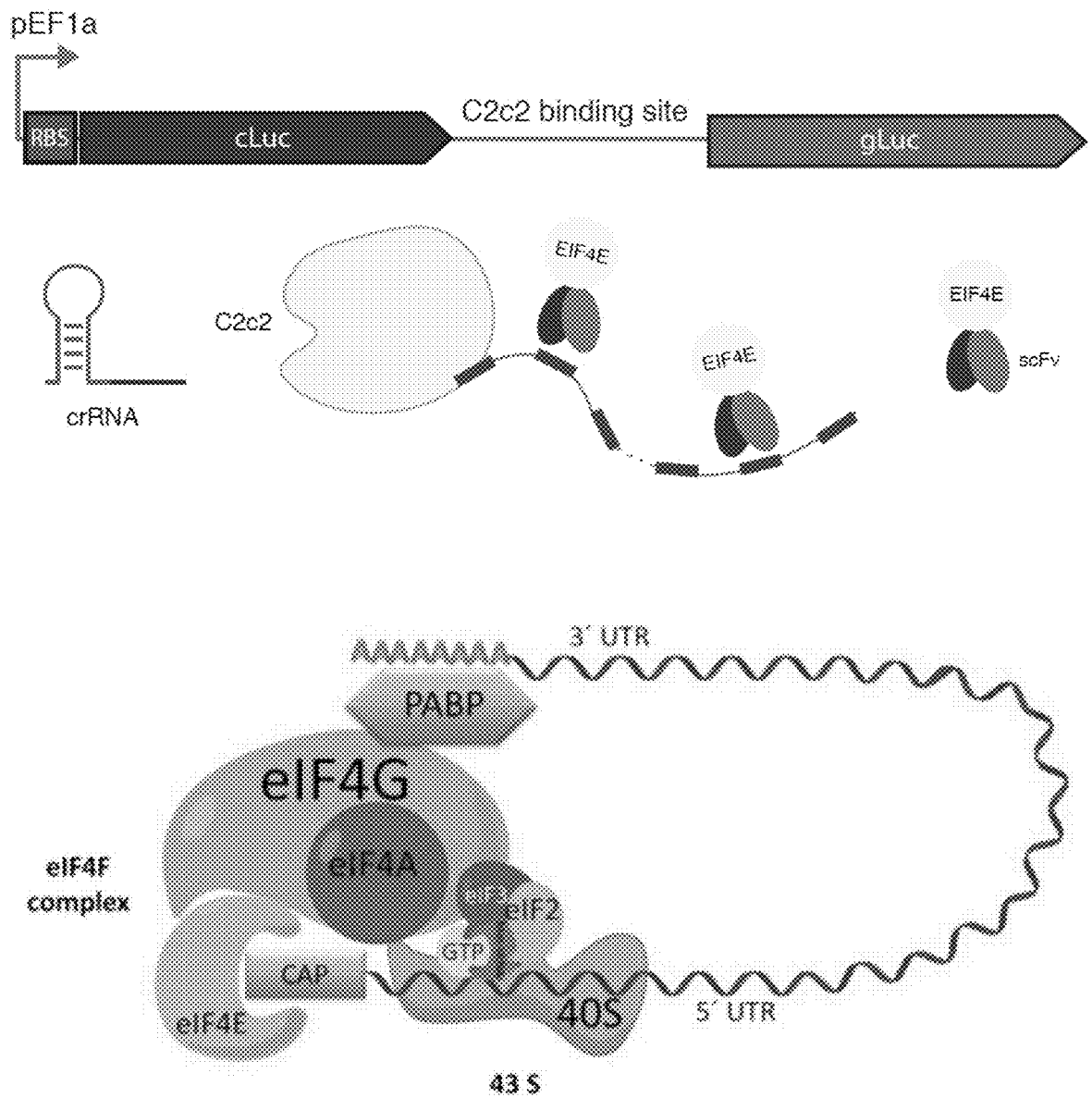
Figure 22C:
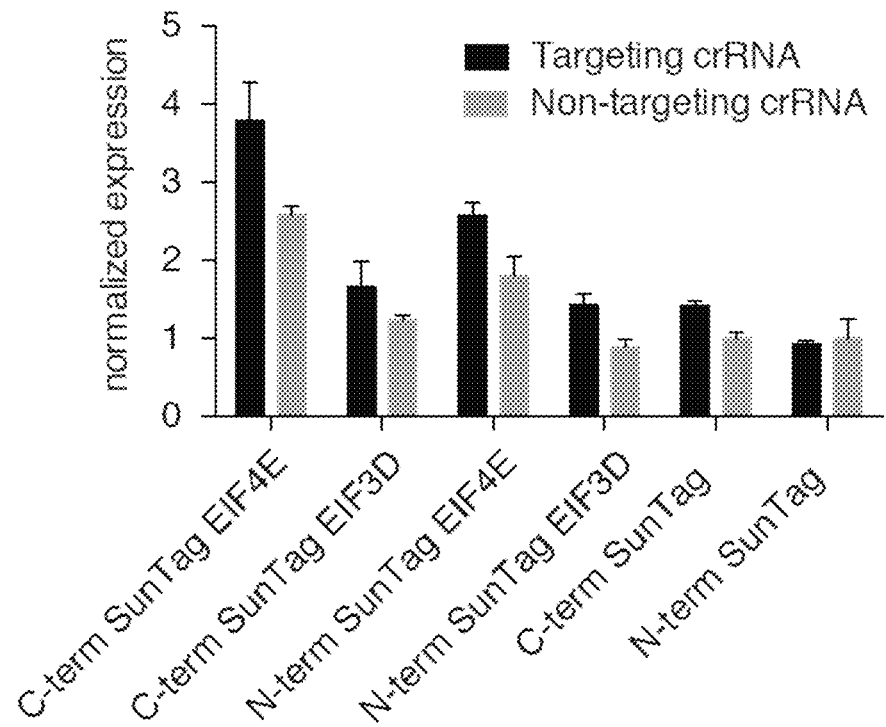
Figure 22D:
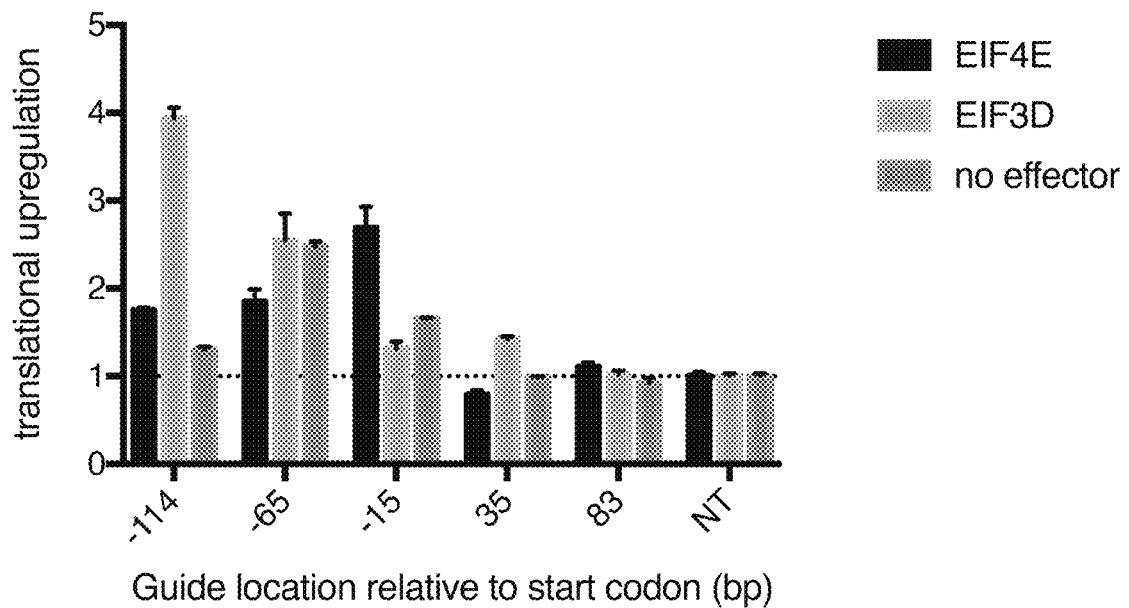

FIG. 22B-22D illustrates a protein tagging system for regulating transcription with C2c2 and shows elements of a transcription initiation factor-linked scFv binding to short peptide sequences comprised by a modified C2c2 (SunTag). FIG. 22C-22D depicts transcriptional effects of the system.

Figure 23A:
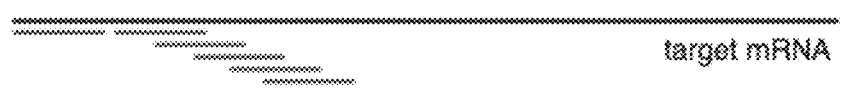
Figure 23B:
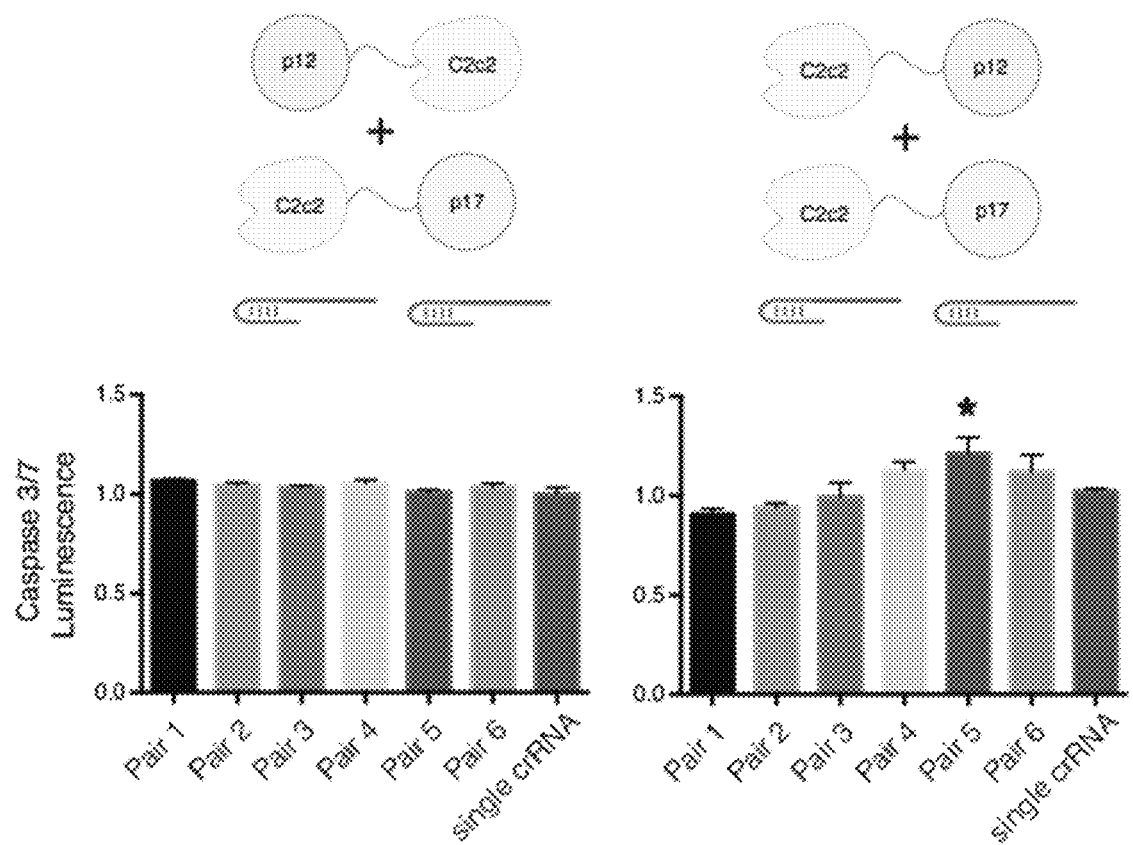

FIG. 23A-23B. Splitting of reporter proteins (GFP, Venus, Cre etc.). Each part is fused to C2c2 (see slide for example schematic with Caspase). By designing two guides that target a transcript close to each other, the split protein is reconstituted in the presence of the transcript.

Figure 24A:
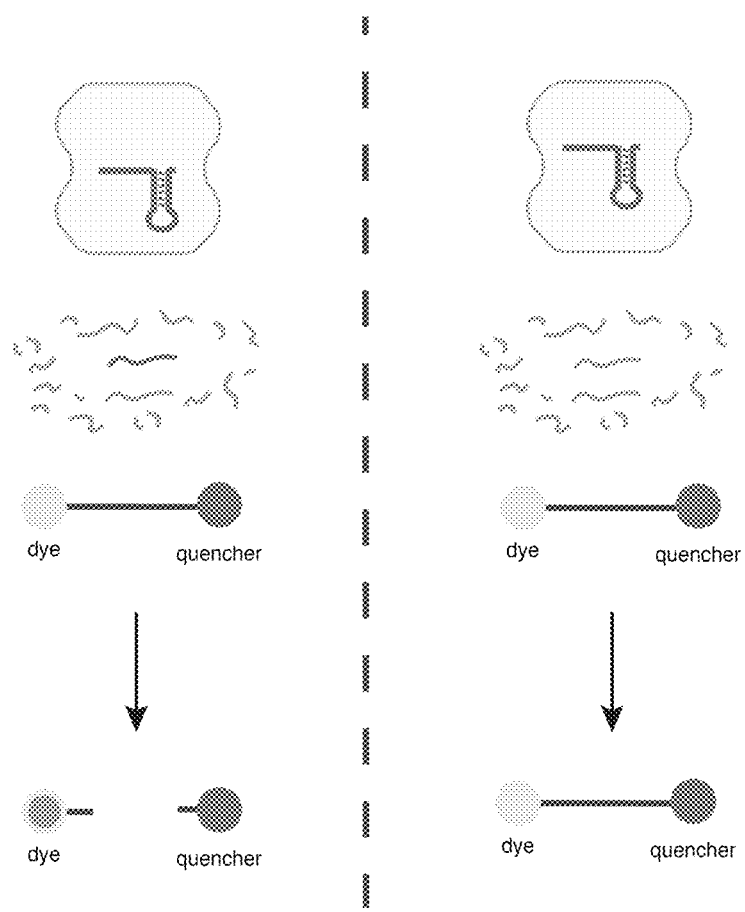
Figures 24B, 24C:
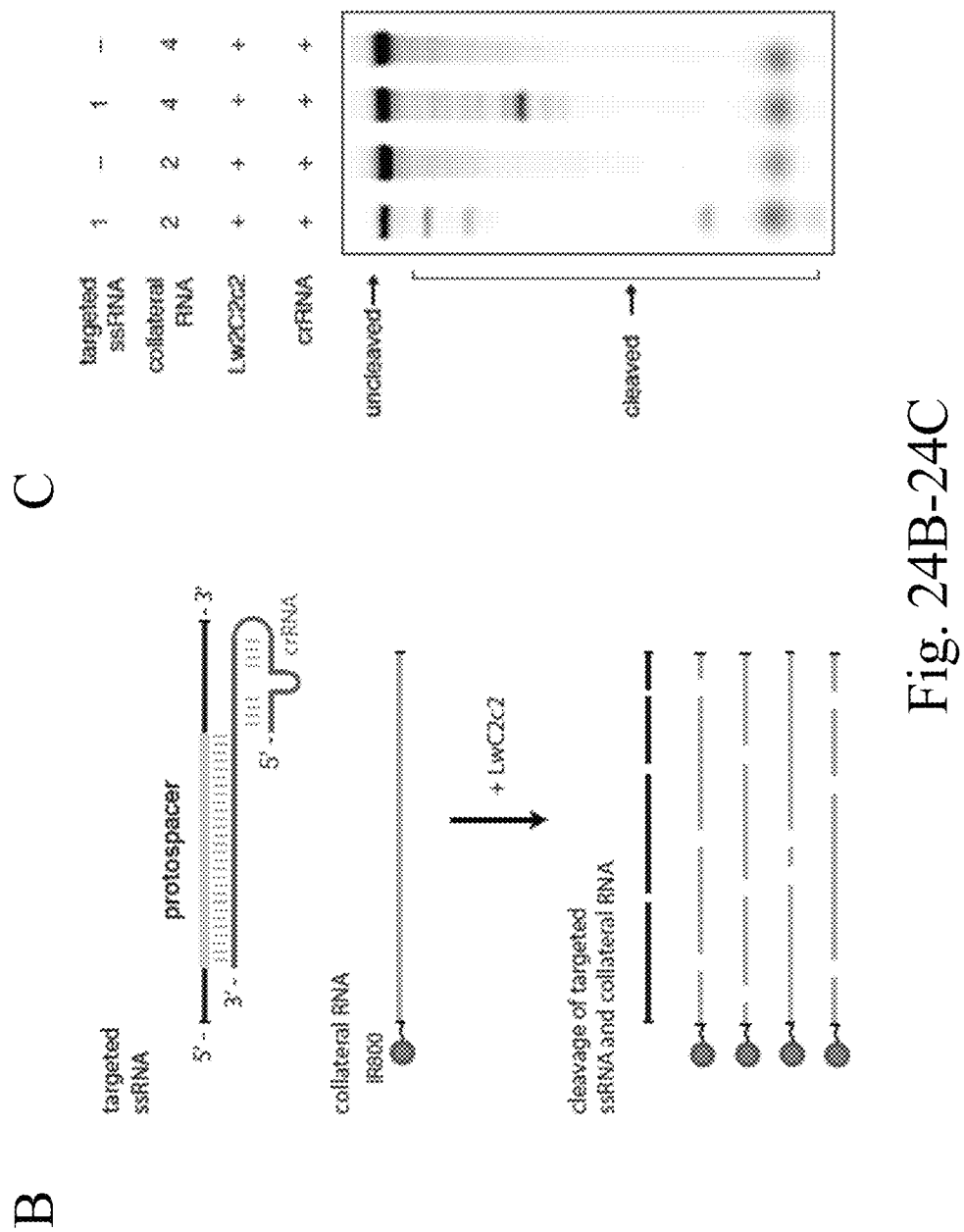

FIG. 24A-24C. Rapid RNA detection by C2c2 collateral RNase activity. (A) Left panel: Activation of C2c2 collateral non-specific RNase activity by target RNA complementary to guide sequence of C2c2 crRNA leads to cleavage of reporter. Right panel: In the absence of target RNA, collateral non-specific RNase activity is not induced, hence there is no cleavage of reporter. (B) Schematic of assay for detecting the activity of the collateral effect by LwaCas13a. (C) Gel electrophoresis of collateral RNA targets after incubation with LwaCas13a-crRNA complex in the presence or absence of target RNA.

Figure 25:
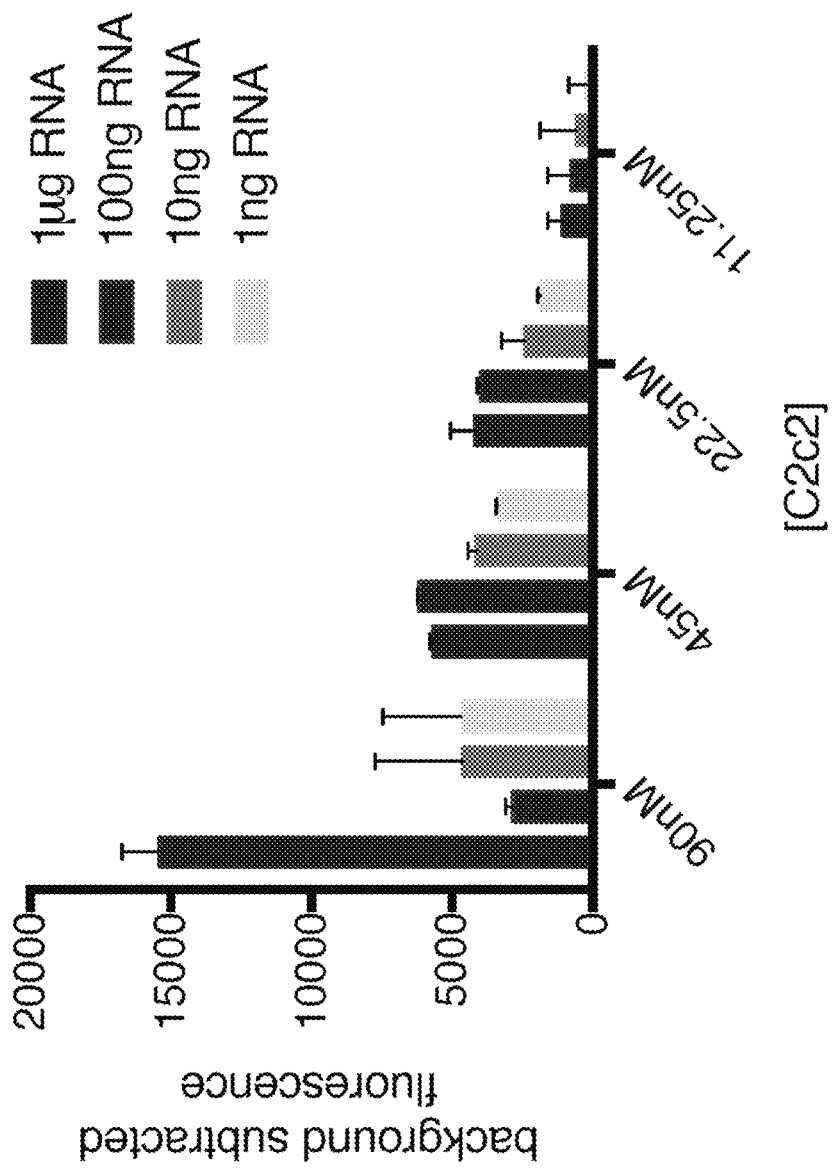

FIG. 25. Lentivirus detection by collateral effect using various concentrations of C2c2.

Figure 26:
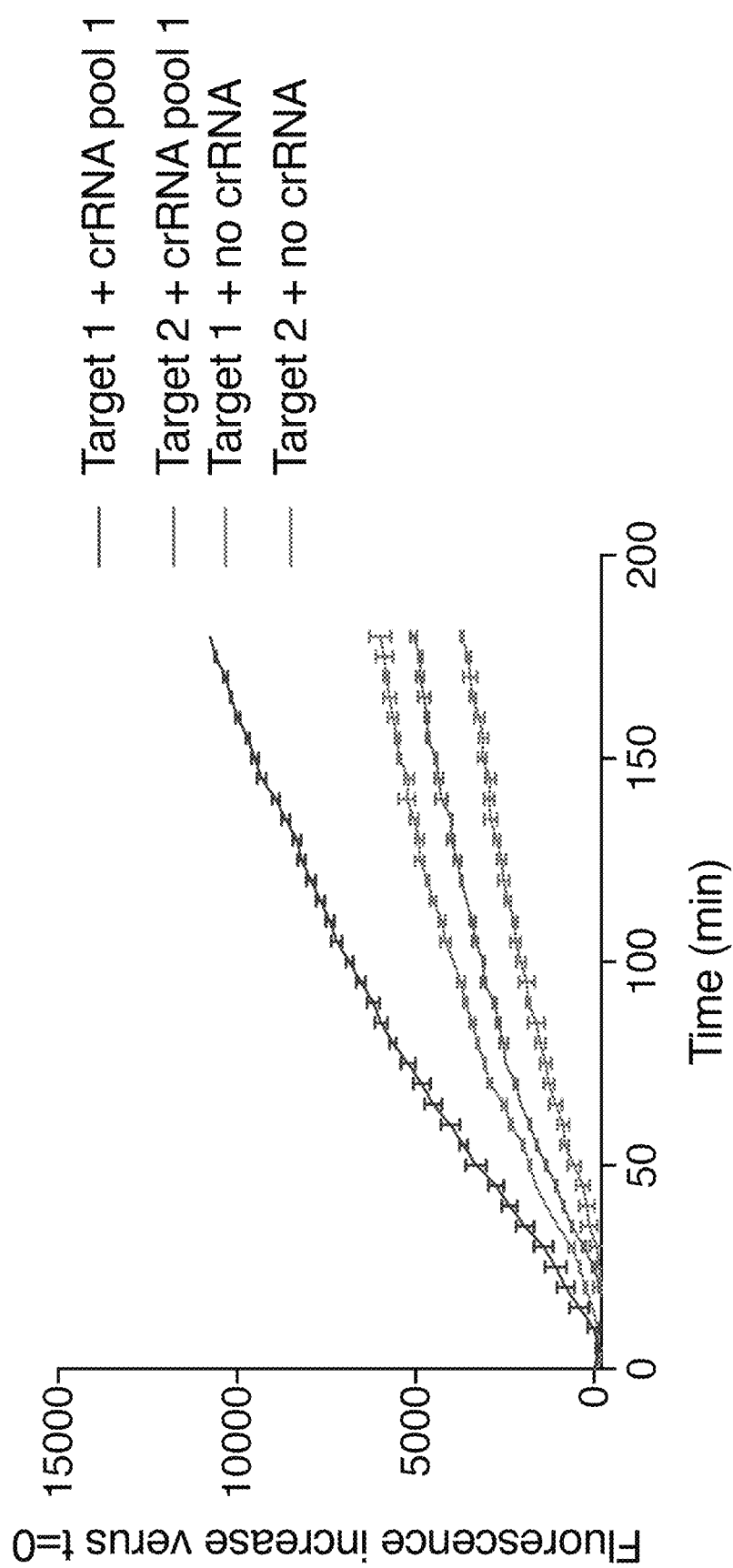

FIG. 26. Time course of lentivirus detection by collateral effect.

Figure 27:
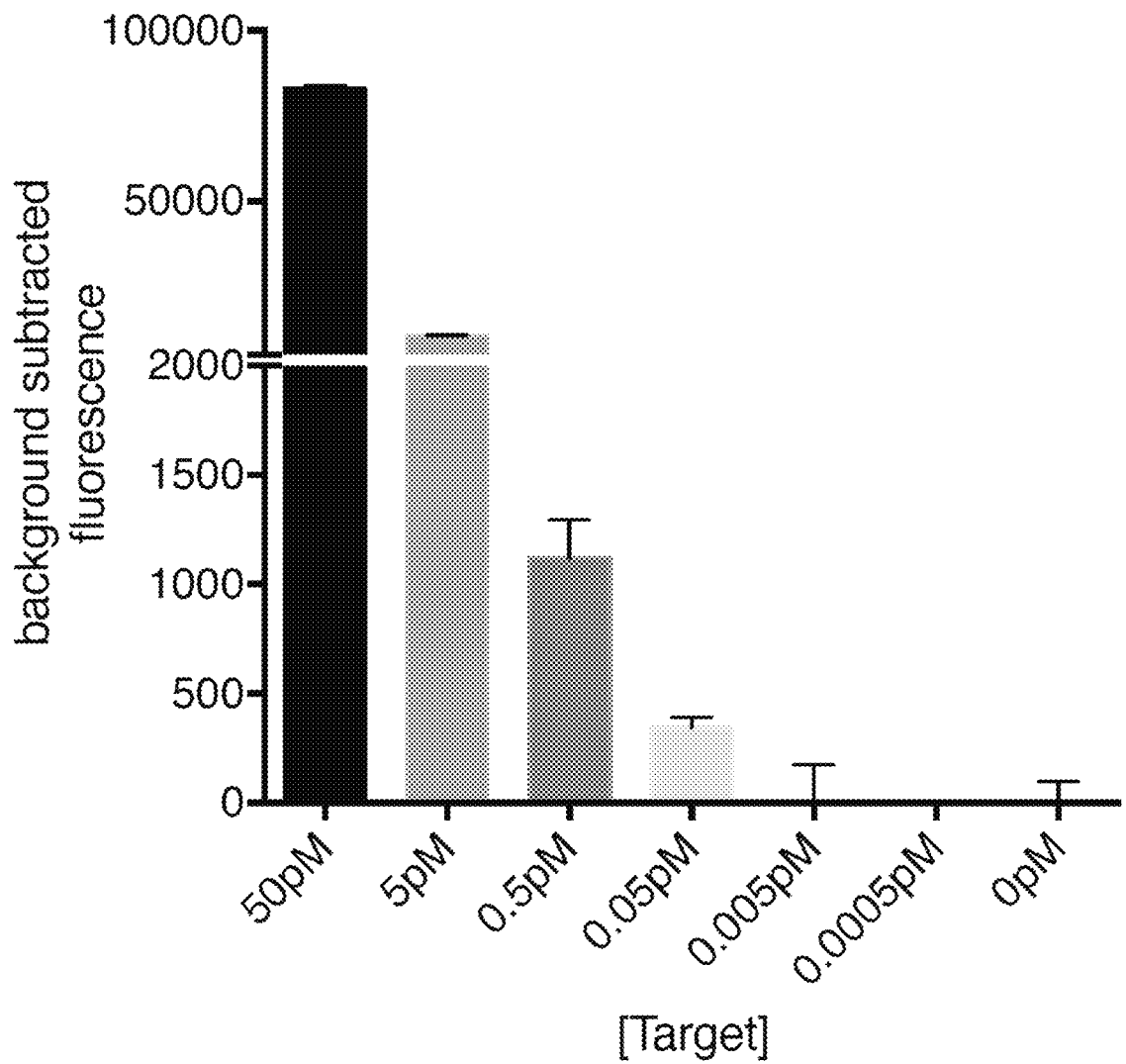

FIG. 27. Detection of rare RNA species by C2c2 collateral RNase activity. Increasing target concentration and target cleavage is accompanied by increased non-specific off-target RNase activity.

FIG. 28A-28B. Alignment of Lw2C2c2 (SEQ ID NO: 412) and LbuC2c2 (SEQ ID NO: 74).

Figures 29A, 29B, 29C:
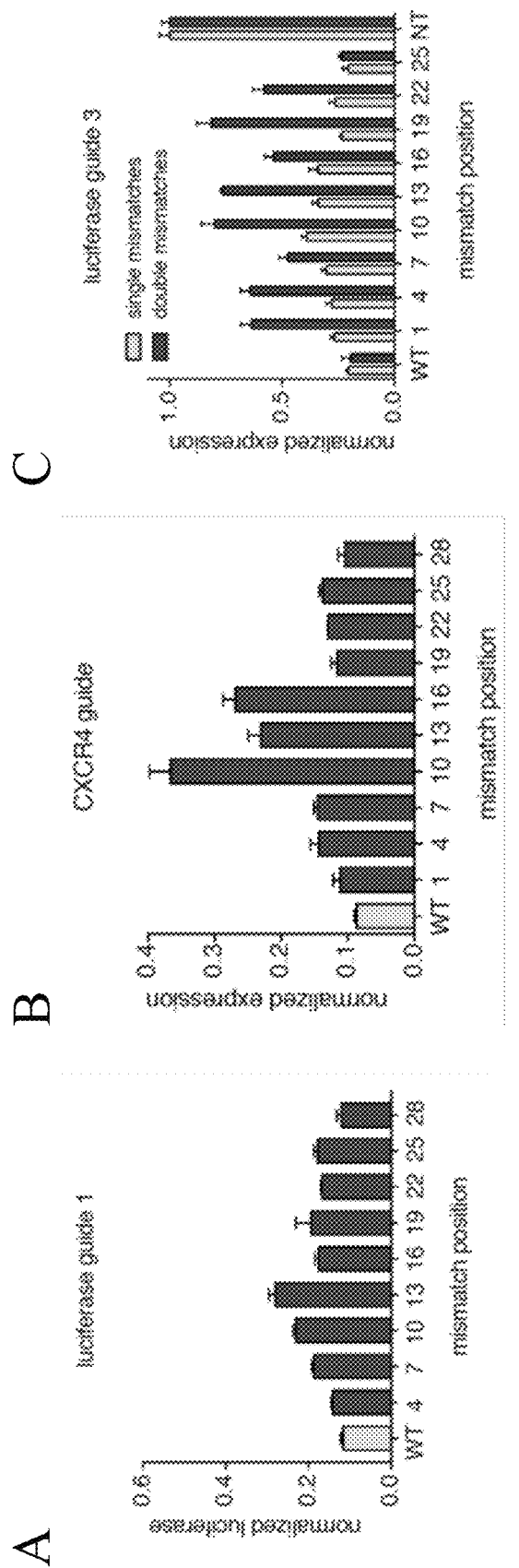

FIG. 29A-29C. (A) PLwC2c2 targeted for luciferase mRNA knockdown with single base-pair mismatches in the spacer sequence. (B) LwC2c2 targeted for CXCR4 mRNA knockdown with single base-pair mismatches in the spacer sequence. (C) LwC2c2 targeted for luciferase mRNA knockdown with single and consecutive double base-pair mismatches in the spacer sequence.

FIG. 29D-I to 29D-III. (I) Specificity of knockdown of luciferase reporter mRNA. C2c2 is more specific than RNAi for knockdown of luciferase reporter mRNA. Left: Expression levels in log 2(transcripts per million (TPM)) values of all detected genes in RNA-seq libraries of non-targeting-transfected controls (x axis of all graphs) compared to the luciferase knockdown condition for shRNA. Right: Expression levels in log 2(transcripts per million (TPM)) values of all detected genes in RNA-seq libraries of non-targeting-transfected controls (x axis of all graphs) compared to the luciferase knockdown condition for C2c2. The target luciferase transcript targeted for knockdown is indicated by the red dot. The average from n=3 biological replicates is shown. (II) Specificity of knockdown of endogenous KRAS mRNA. C2c2 is more specific than RNAi for knockdown of endogenous KRAS. The target transcript is indicated by the red dot. (III) Specificity of knockdown of endogenous PPIB mRNA. C2c2 is more specific than RNAi for knockdown of endogenous PPIB. The target transcript is indicated by the red dot.

Figures 29E, 29F, 29G:
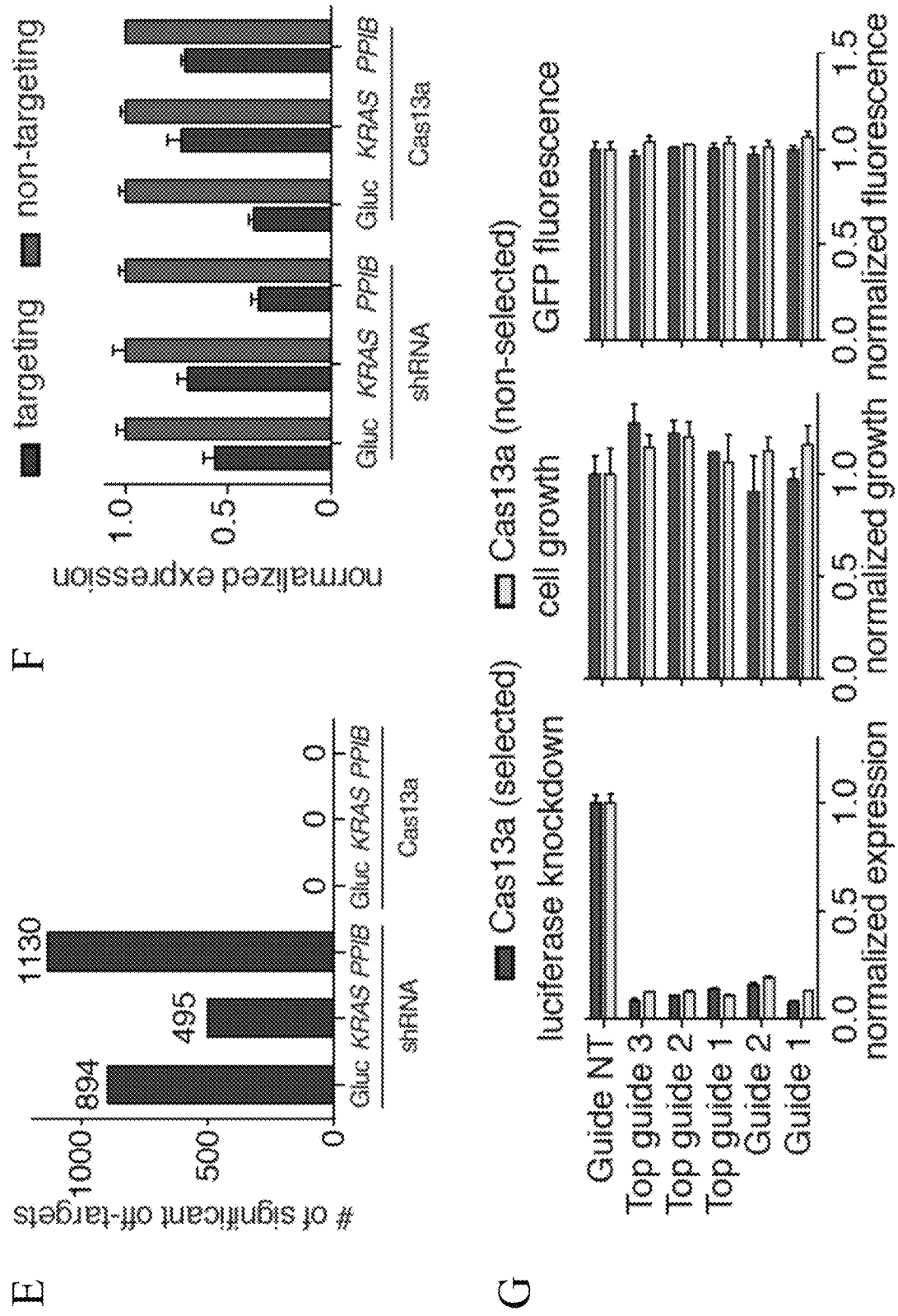

FIG. 29E-29G. (E) Differential gene expression analysis of six RNA-seq libraries (each with three biological replicates) comparing LwaCas13a knockdown to shRNA knockdown at three different genes. Genes are considered significantly differentially expressed if they have a mean fold change >2 or <0.75 compared to non-targeting controls and have a false-discovery rate (FDR) <0.10. (F) Quantified mean knockdown levels for the targeted genes from the RNA seq libraries. (G) Left: Luciferase knockdown for cells transfected with LwaCas13a for 72 hours with and without antibiotic selection prior to measuring cell growth. Middle: Cell viability for cells that have been transfected with LwaCas13a for 72 hours with and without antibiotic selection. Right: GFP fluorescence of cells that have been transfected with LwaCas13a for 72 hours with and without antibiotic selection. All values are mean±SEM with n=3.

FIG. 30A-30E. Comparison of level and specificity of RNA knockdown. C2c2 demonstrates increased specificity while maintaining similar levels of knockdown as RNAi. (A) The number of significant differentially regulated genes in each RNA-seq library analyzed. Differential gene expression analysis of six RNA-seq libraries (each with three biological replicates) comparing LwaCas13a knockdown to shRNA knockdown at three different genes. Genes are considered significantly differentially expressed if they have a mean fold change >2 or <0.75 compared to non-targeting controls and have a false-discovery rate (FDR)<0.10. (B) Quantified mean knockdown levels for the targeted genes from the RNA seq libraries. Normalized expression is calculated as the TPM of the targeted gene in the targeting condition divided by the TPM of the targeted gene in the non-targeted condition. The plots represent accumulated data of RNA-seq plots in FIG. 28. Off-targets are determined as genes that are significantly unregulated (>2 fold) or down-regulated (<6969 (C) Luciferase knockdown for cells transfected with LwaCas13a for 72 hours with a non-selectable and blasticidin-selectable version of C2c2. (D) Cell viability for cells that have been transfected with LwaCas13a for 72 hours with and without antibiotic selection. (E) GFP fluorescence of cells that have been transfected with LwaCas13a for 72 hours with and without antibiotic selection.

Figures 3C, 3D:
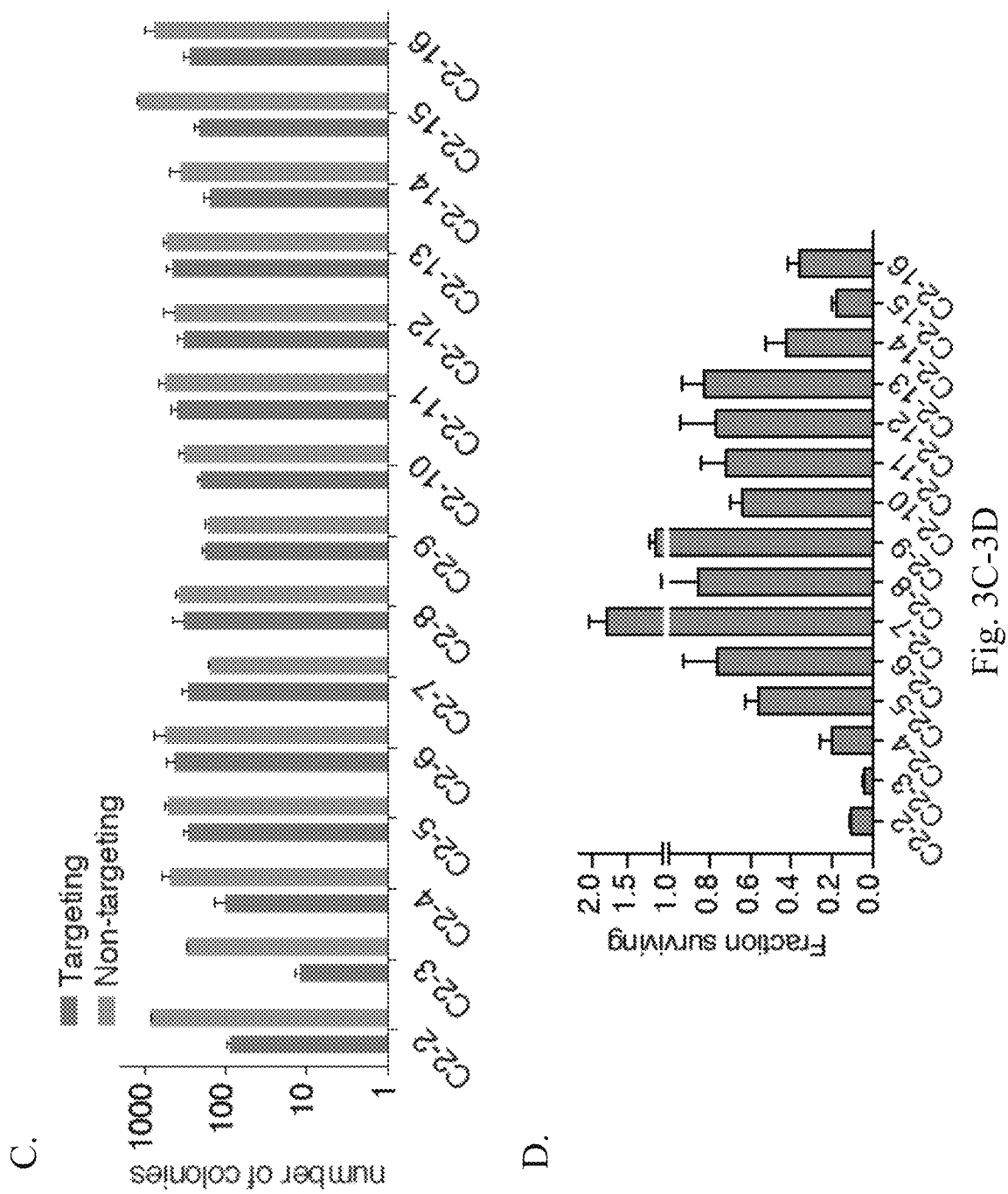
FIG. 3A-3Q. Characterization of the type VI CRISPR Cas13a family for RNA cleavage activity. (A) Schematic of PFS characterization screen on Cas13a orthologs. (B) Schematic of constructs for expression of Cas13a protein and crRNA. Length and residue numbers shown are for LwaCas13a. (C) Quantitation of Cas13a in vivo activity. (D) Ratios of in vivo activity from (C). (E, F) The PFS motif determination for LshC2c2 and LwaC2c2, as determined by next generation sequencing of enriched plasmids in the surviving *E. coli* population. (G) Distributions of PFS enrichment for LshCas13a and LwaCas13a in targeting and non-targeting samples. (H) In vivo PFS screening shows LwaCas13a has a minimal PFS preference. (I) Box plot showing the distribution of normalized PFS counts for targeting and non-targeting bio-replicates (n=2) for LshC2c2 and LwC2c2. The box extends from the first to third quartile with whiskers denoting 1.5 times the interquartile range. The mean is indicated by the red horizontal bar. (J) Comparison of LshC2c2 and LwC2c2 RNA cleavage activity using purified protein. LwaCas13a has more active RNAse activity than LshCas13a. A 5' labeled RNA target was incubated with C2c2 and corresponding crRNA for 30 min and the products were analyzed by gel electrophoresis. (K) LwaCas13a can process CRISPR array transcripts from the *L. wadei* CRISPR locus. A two-spacer Lwa array was incubated with LwC2c2 for 30 min and the reaction was then resolved by gel electrophoresis. (L) Schematic of mammalian LwaCas13a constructs evaluated and imaging showing the localization and expression of each of the designs. Scale bars, 10 μm. (M) Schematic of the mammalian reporter system used to evaluate knockdown by a luciferase protein readout. (N) Knockdown of *Gaussia* luciferase (Gluc) using engineered variants of LwaCas13a. Sequences for guides (SEQ ID NOS: 410 and 411, respectively, in order of appearance) and shRNAs are shown above. (O) Knockdown of three different endogenous transcripts with LwaCas13a compared against corresponding RNAi constructs. (P) Schematic for LwaCas13a knockdown of transcripts in rice (*Oryza sativa*) protoplasts. (Q) LwaCas13a knockdown of three transcripts in *Oryza sativa* protoplasts using three targeting guides and a non-targeting guide per transcript. All values are mean±SEM with n=3, unless otherwise noted.
Figures 3E, 3F, 3G, 3H, 3I:
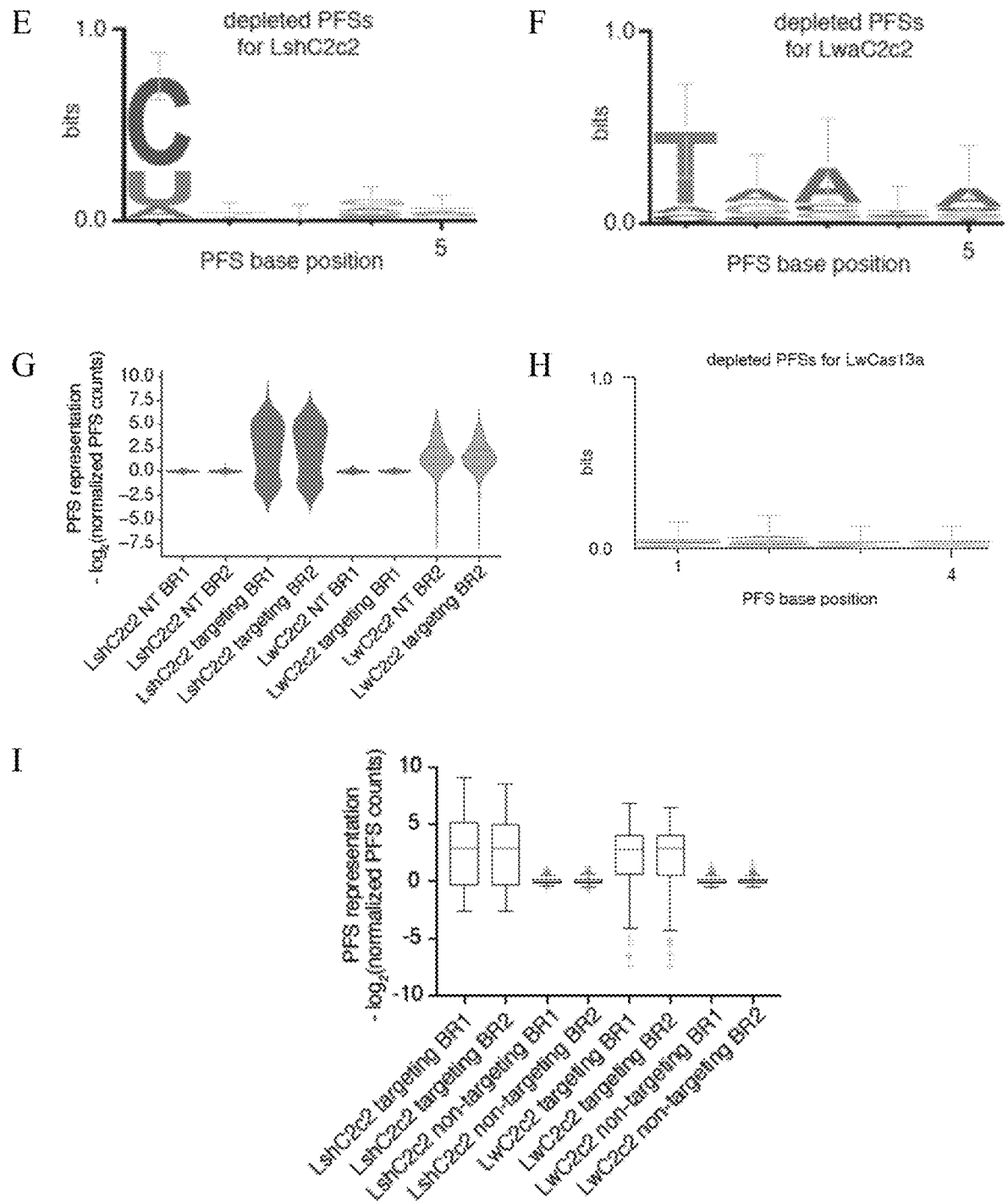

FIG. 3I. C2c2 is capable of multiplexed knockdown. crRNA was designed to target PPIB, CXCR4, KRAS, TINCR, and PCAT. The top panel shows normalized expression levels of the mRNAs color-coded and in the same order left-to-right as the depicted multiplexed crRNA transcript. The bottom panel compares singly dosed guides with multiplexed and pooled guides.

FIG. 32A-32D. Tiling guides along the length of gLuc or cLuc demonstrates retargetability and regions of vulnerability on transcript. (A) Schematic of LwaCas13a arrayed screening (SEQ ID NOS: 413-418, respectively, in order of appearance). (B) Knockdown efficiency of Gaussia luciferase mRNA by LwC2c2 with 186 guides tiled evenly across the length of the transcript. (C) Arrayed knockdown screen of Cypridina luciferase by LwC2c2 with guides tiled evenly across the length of the transcript. (D) Validation of the top three crRNAs from the arrayed knockdown screens with shRNA comparisons.

Figure 33A:
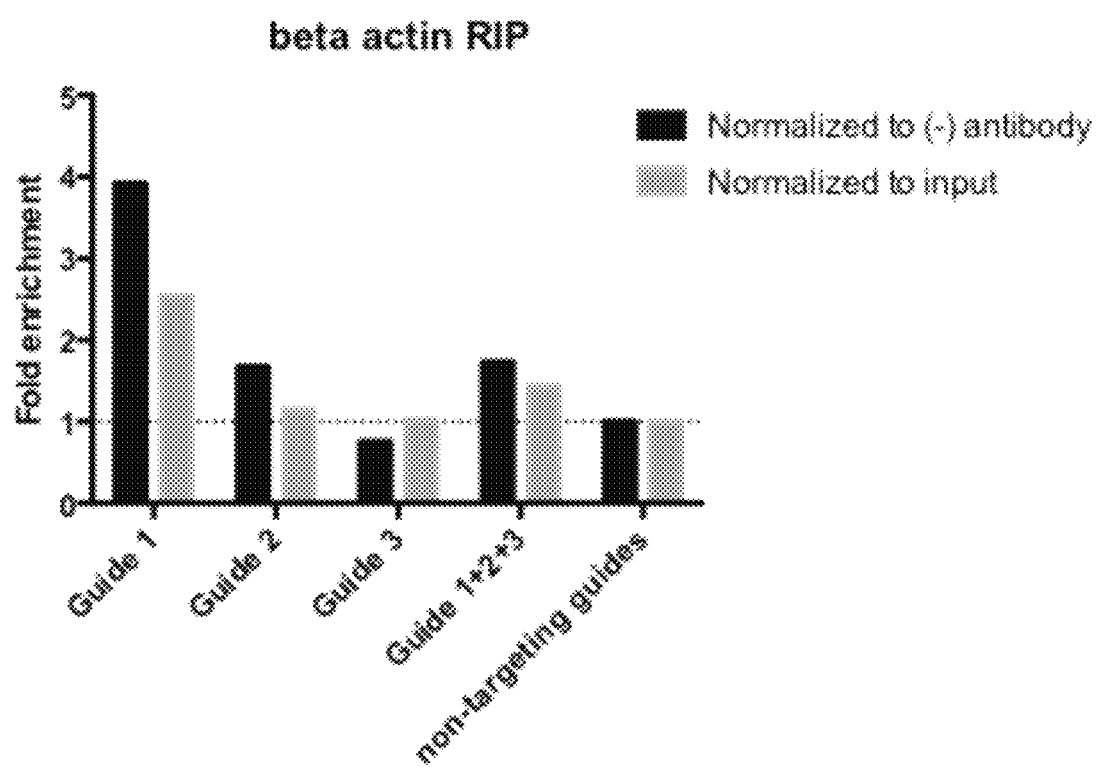
Figure 33B:
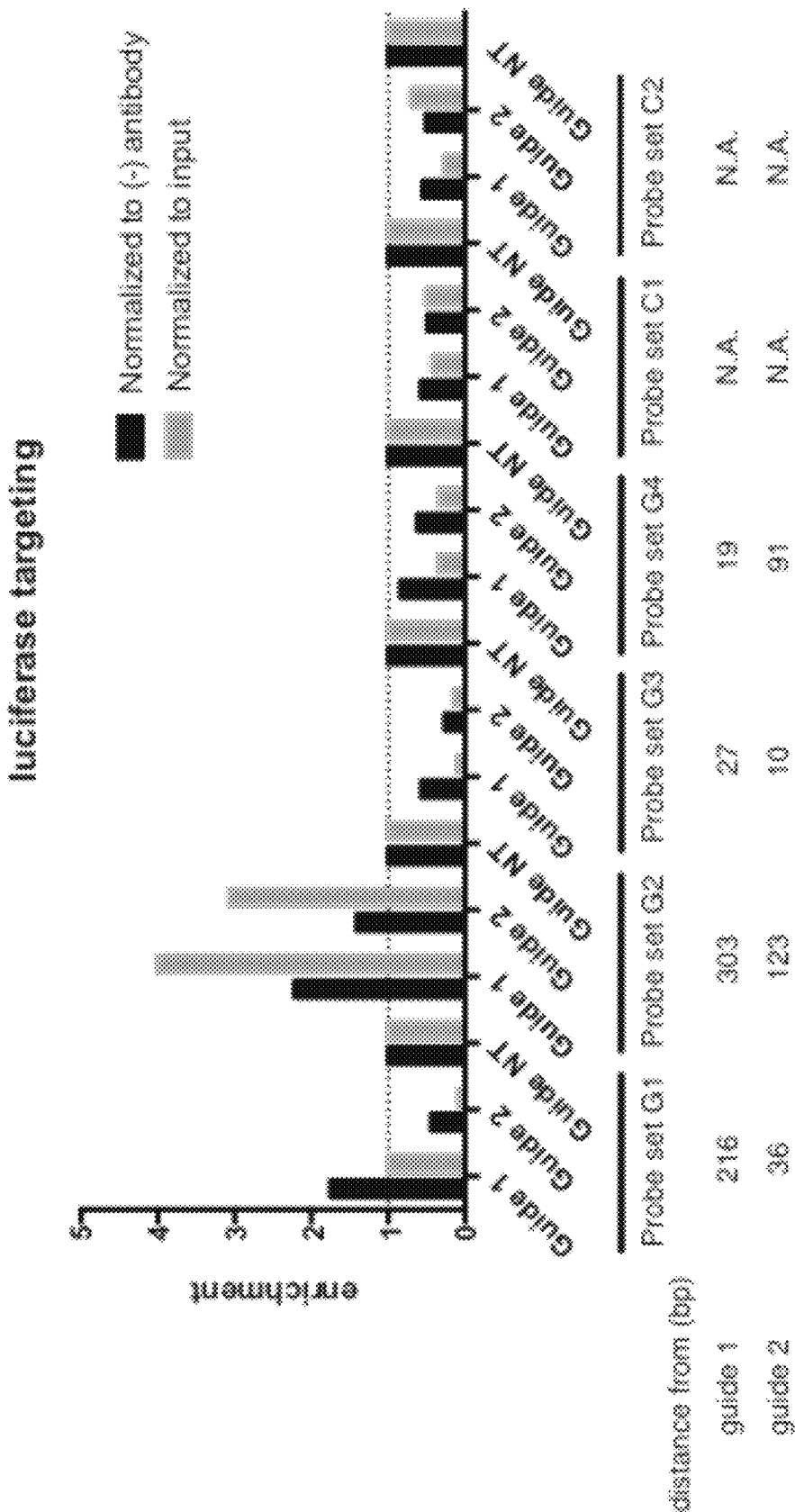

FIG. 33A-33B. RNA Immunoprecipitation (RIP) shows enrichment of target binding. dC2c2-msfGFP comprising an HA-tag provided for precipitation of the protein-RNA complex. Bound RNA was quantified by qPCR and enrichment determined in comparison to input RNA (sample without immunoprecipitation) and immunoprecipitation with a negative control antibody. Panel A shows enrichment of beta-actin RNA target. Panel B shows enrichment of luciferase target.

Figure 34:
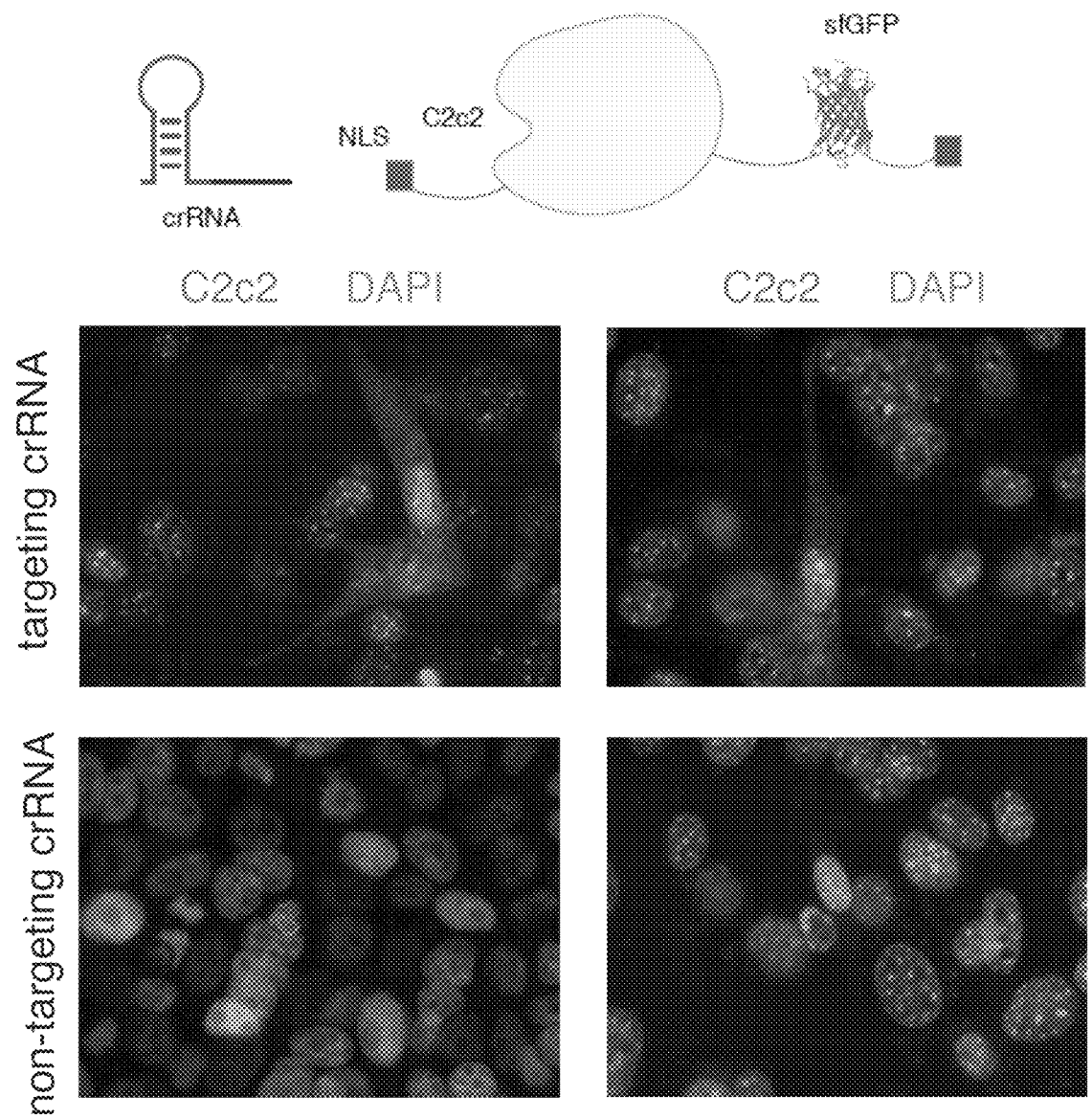

FIG. 34. C2c2 imaging of Beta-actin in 3T3L1 fibroblasts. In the targeting condition (top frames) C2c2 complex binds actin mRNA leaving the nucleus, revealing cytoplasmic Beta-actin mRNA. In the non-targeting condition, NLS-tagged C2c2 is observed in the nucleus. Left and right columns constitute different views.

Figure 35:
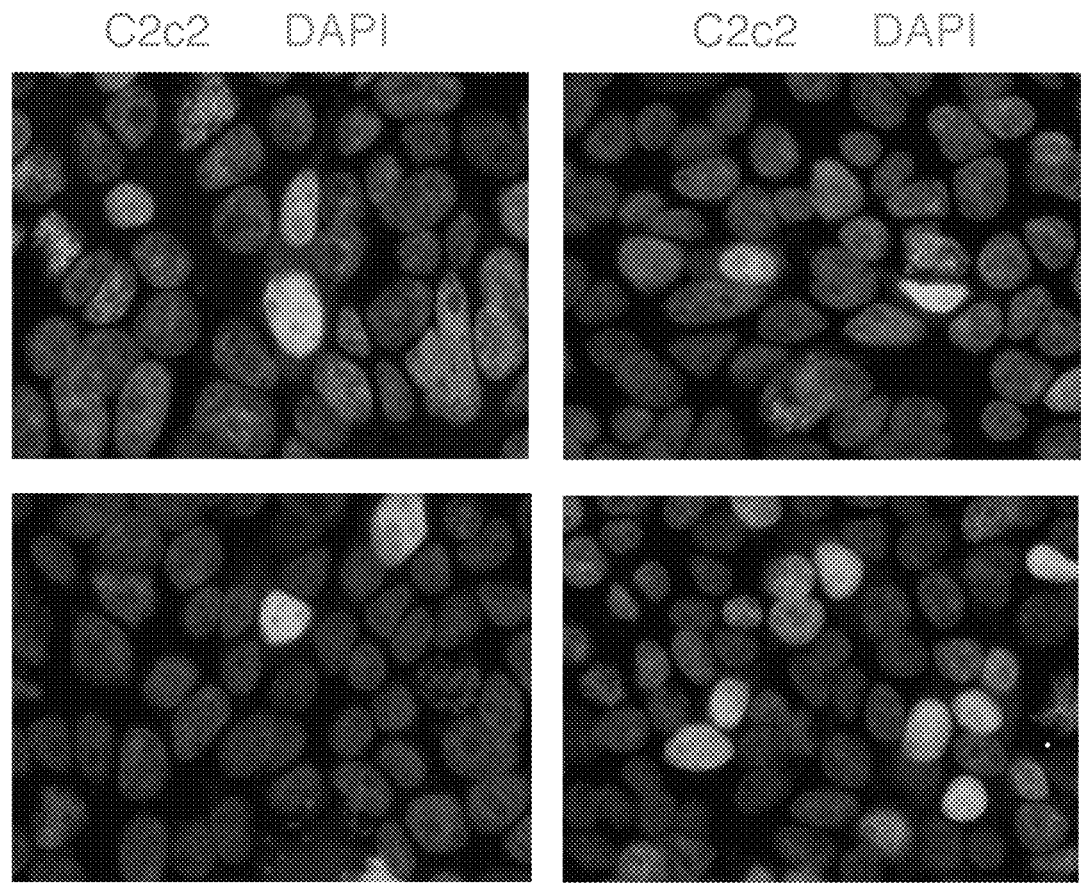

FIG. 35. C2c2 imaging of Beta-actin in HEK293FT cells. In the targeting condition (top frames) C2c2 complex binds actin mRNA leaving the nucleus, revealing cytoplasmic Beta-actin mRNA. In the non-targeting condition, NLS-tagged C2c2 is observed in the nucleus. Left and right columns constitute different views.

Figure 36:
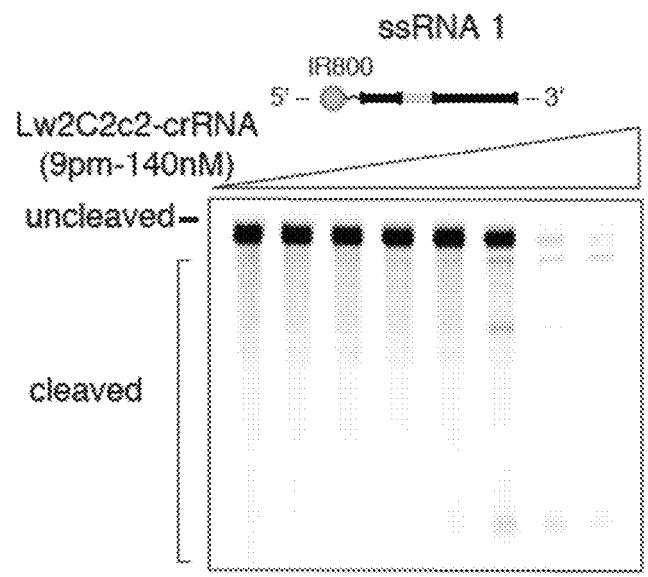

FIG. 36. In vitro characterization of the RNA cleavage kinetics of Lw2Cas13a. A denaturing gel after 0.5 hour of RNA-cleavage of 5'end-labeled target 1 using LwaCas13a-crRNA complex that is serially diluted in half-log steps.

Figure 37:
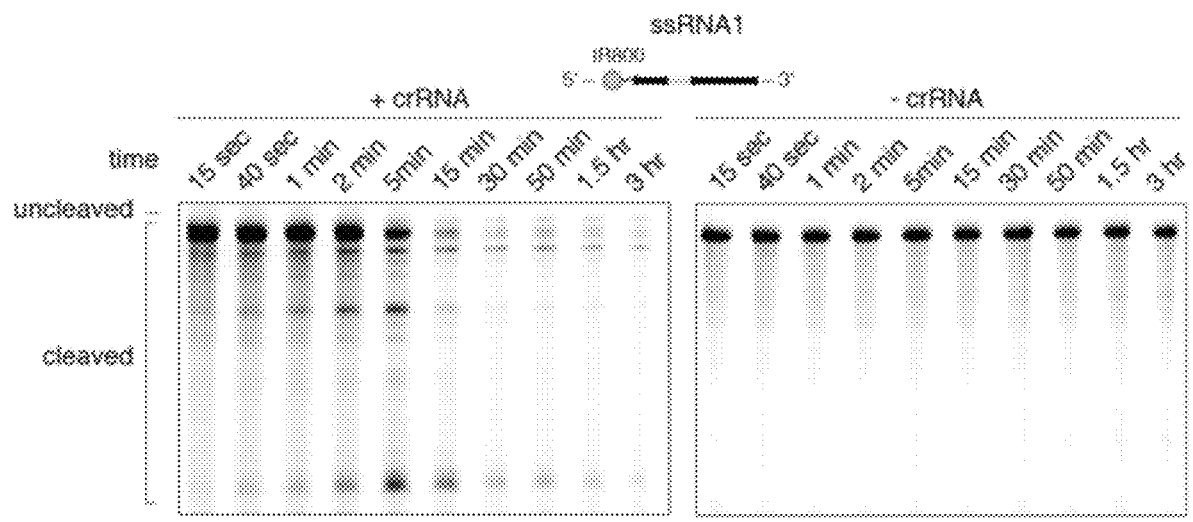

FIG. 37. In vitro characterization of the RNA cleavage kinetics of Lw2Cas13a. Denaturing gel of a time series of Lw2Cas13a ssRNA cleavage using a 5' end-labeled target 1.

Figure 38:
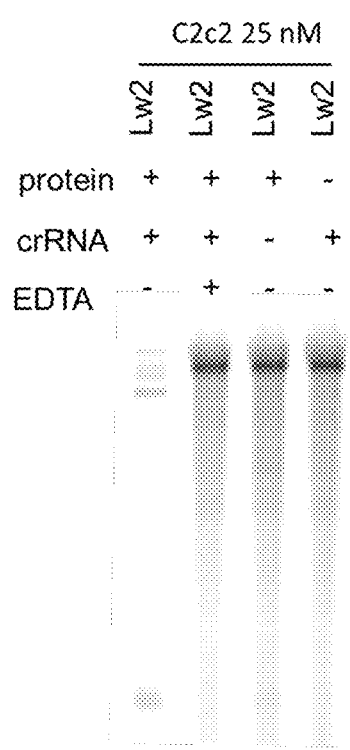

FIG. 38. Lw2C2c2 and crRNA mediate RNA-guided ssRNA cleavage. A denaturing gel demonstrating crRNA-mediated ssRNA cleavage by Lw2 C2c2 after 1 hour of incubation. The ssRNA target is 5' labeled with IRDye 800. Cleavage requires the presence of the crRNA and is abolished by addition of EDTA.

Figure 39A:
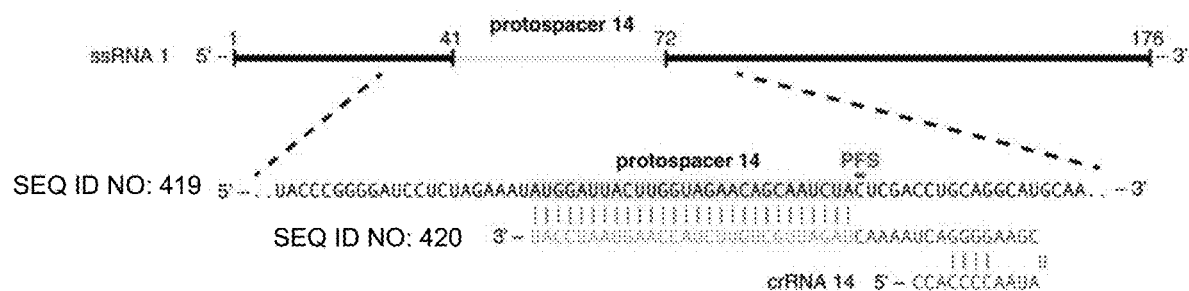
Figure 39B:
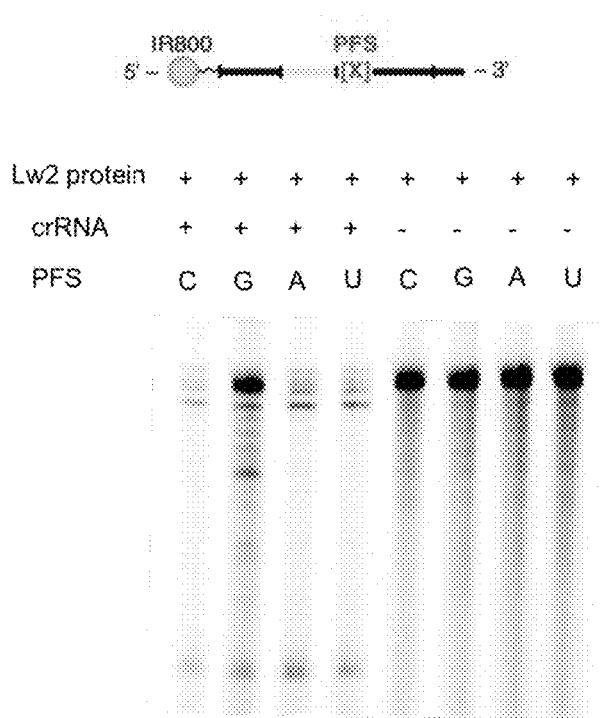

FIG. 39A-39B. Lw2C2c2 and crRNA mediate RNA-guided ssRNA cleavage. (A) Schematic of the ssRNA substrate (SEQ ID NO: 419) being targeted by the crRNA (SEQ ID NO: 420). The protospacer region is highlighted in blue and the PFS is indicated by the magenta bar. (B) A denaturing gel demonstrating the requirement for an PFS after 3 hours of incubation. Four ssRNA substrates that are identical except for the PFS (indicated by the magenta X in the schematic) were used for the in vitro cleavage reactions. ssRNA cleavage activity is dependent on the nucleotide immediately 3' of the target site.

FIG. 40. Direct repeat length affects the RNA-guided RNase activity of Lw2C2c2. Denaturing gel showing crRNA-guided cleavage of ssRNA 1 as a function of direct repeat length after 3 hours of incubation. Figure discloses SEQ ID NO: 421.

Figure 41:
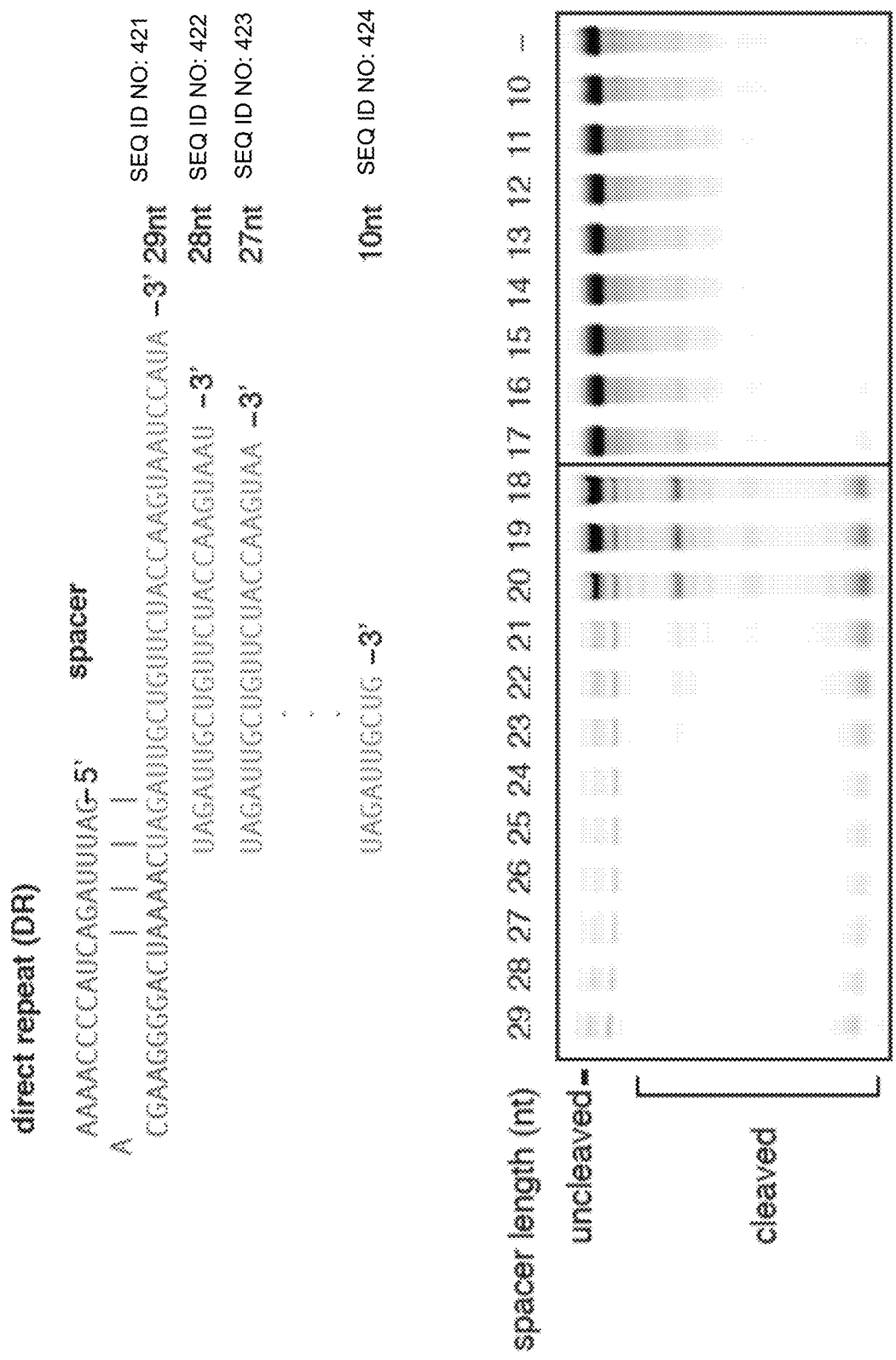

FIG. 41. Spacer length affects the RNA-guided RNase activity of Lw2C2c2. Denaturing gel showing crRNA-guided cleavage of ssRNA 1 as a function of spacer length after 3 hours of incubation. Figure discloses SEQ ID NOS: 421-424, respectively, in order of appearance.

Figures 42A, 42B, 42C:
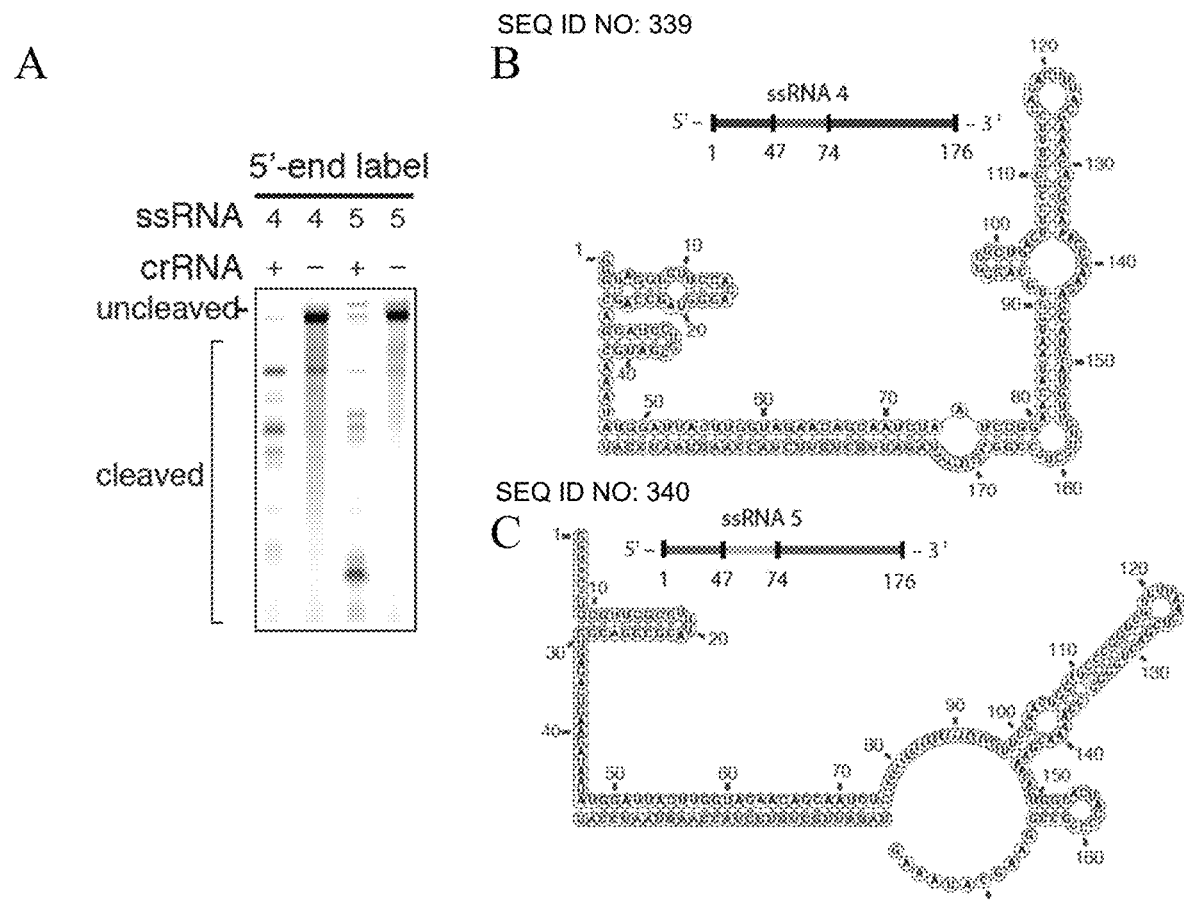

FIG. 42A-42C. Lw2C2c2 cleavage sites are determined by secondary structure and sequence of the target RNA. (A) Denaturing gel showing ssRNA 4 and ssRNA 5 after incubation with LwaCas13a and crRNA 1. (B) ssRNA 4 (blue) (SEQ ID NO: 339) and (C) ssRNA 5 (SEQ ID NO: 340); (green) share the same protospacer but are flanked by different sequences. Despite identical protospacers, different flanking sequences resulted in different cleavage patterns.

Figures 43A, 43B, 43C:
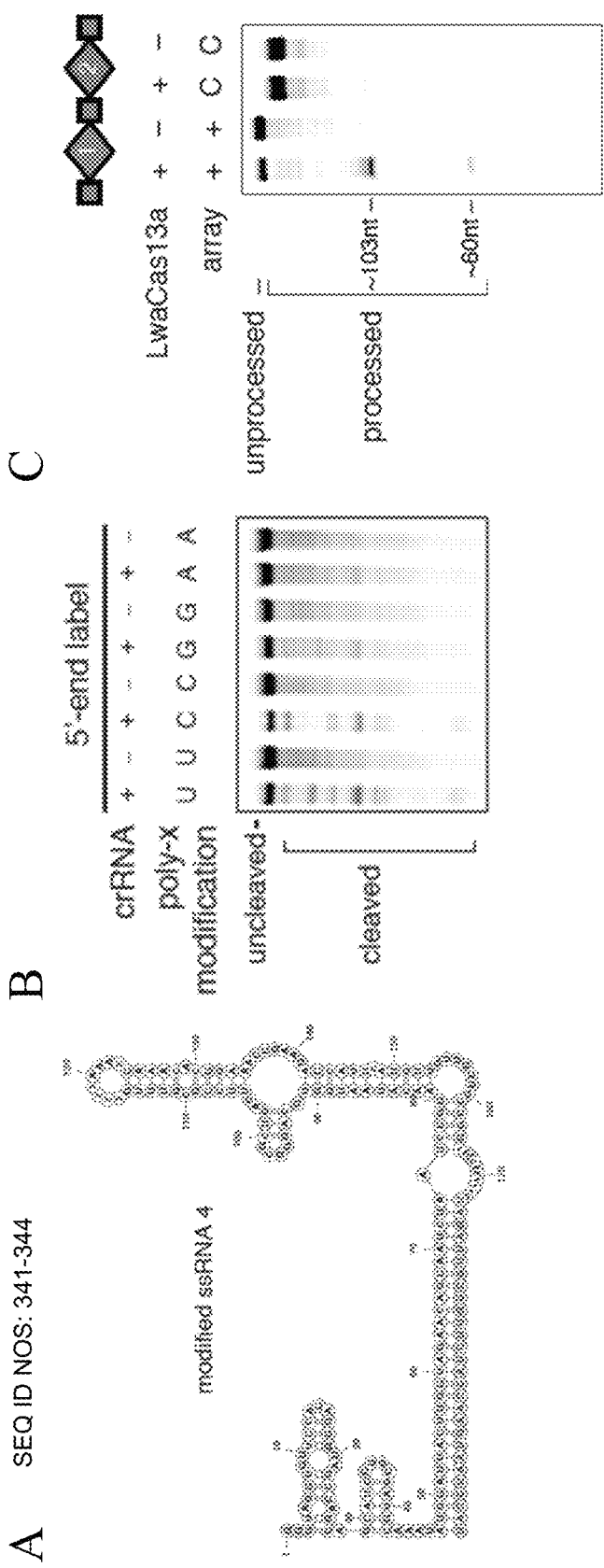

FIG. 43A-43C. (A) Schematic of ssRNA 4 modified with a homopolymer stretch in the highlighted loop (red) for each of the four possible nucleotides (SEQ ID NOS: 341-344). crRNA spacer sequence is highlighted in blue. (B). Denaturing gel showing Lw2C2c2-crRNA-mediated cleavage for each of the four possible homopolymer targets after 3 hours of incubation. Lw2C2c2 cleaves C and U. (C) LwaCas13a can process pre-crRNA from the *L. wadei* CRISPR-Cas locus.

FIG. 44A-44K. A catalytically-inactive LwaCas13a (dCas13a) is capable of binding transcripts in mammalian cells. (A) Schematic of dCas13a-GFP construct used for imaging and evaluation of dCas13a binding. (B) Schematic of RNA immunoprecipitation for quantitation of dCas13a binding. (C) dCas13a targeting gLuc transcripts is significantly enriched compared to non-targeting controls. Quantification of dC2c2-msfGFP binding for g *Gaussia* luciferase mRNA by RIP normalized to either control antibody or input lysate. Values are normalized to non-targeting guide. (n=3, *, p<0.05; **, p<0.0001 by t-test). (D) Schematic of dCas13a-GFP-KRAB construct used for negative-feedback imaging. In the absence of target and guide, the reporter protein inhibits its own transcription. (E) Gluc, Cluc, PPIB, and KRAS knockdown partially correlates with target accessibility as measured by predicted folding of the transcript. (F) Comparison between localization of dCas13-GFP and dCas13a-GFP-KRAB constructs for imaging b-actin. (G) Representative images for dCas13a-GFP-KRAB imaging with multiple guides targeting b-actin in HEK293 cells. (H) Representative images for dCas13a-GFP-KRAB imaging with multiple guides targeting ACTB. (I) Quantification of cytoplasmic translocation of dCas13a-GFP-KRAB, as measured by the ratio of nuclear to whole-cell signal. (J) Representative fixed immunofluorescence images of 293FT cells treated with 400 µM sodium arsenite. Stress granules are indicated by staining for marker G3BP1. Scale bars, 5 µm. Scale bars, 5 µm. (K) G3BP1 and dCas13a-GFP-KRAB co-localization quantified per cell by Pearson's correlation. All values are mean±SEM with n=3. p<0.0001; *p<0.001; **p<0.01; *p<0.05. ns=not significant. A one-tailed student's t-test was used for comparisons in (a) and a two-tailed student's t-test was used for comparisons in (I) and (K).

Figure 45:
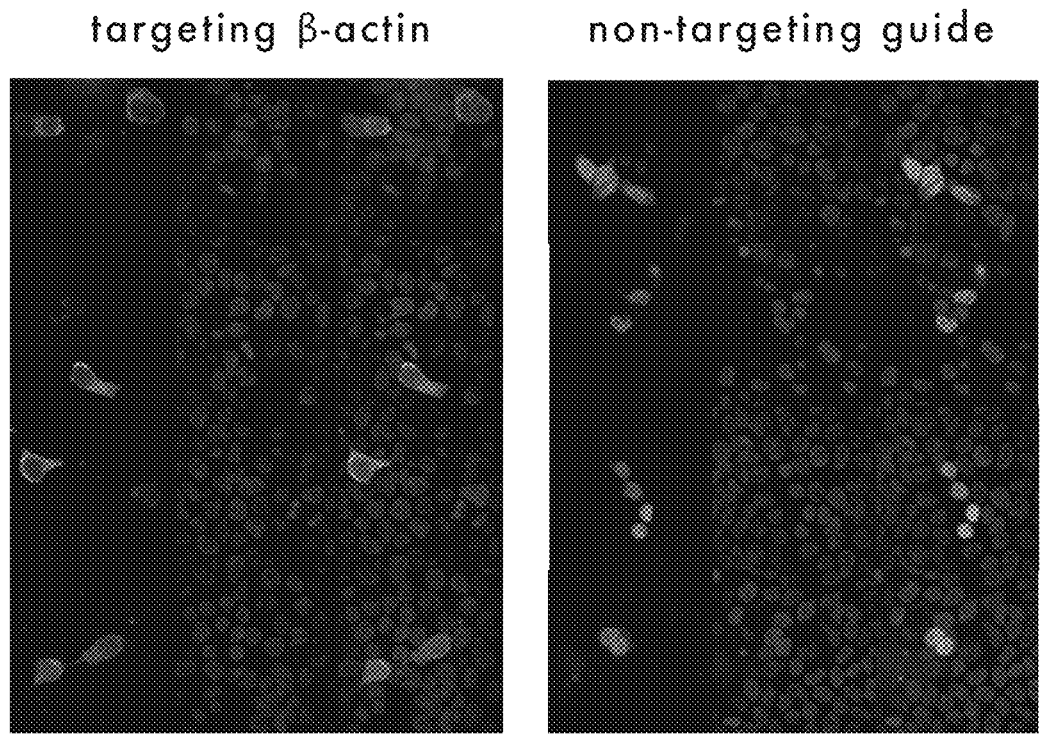

FIG. 45. Detection of B-actin using a C2c2-GFP imaging protein as shown in FIG. 43. β-actin was imaged using dC2c2-eGFP-ZF-KRAB-NLS with a targeting guide (left panel) of a non-targeting guide (right panel).

Figure 46:
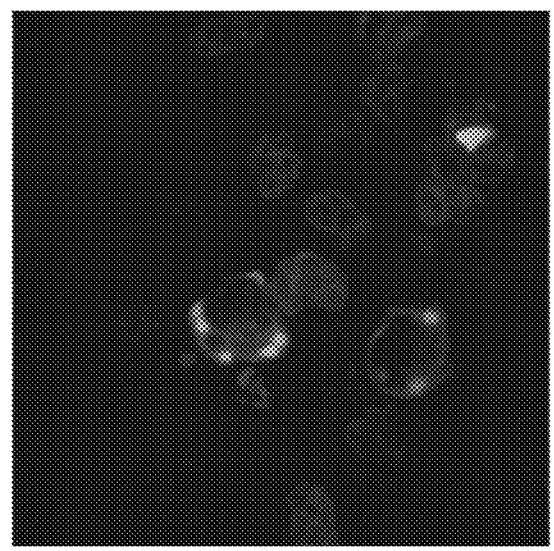

FIG. 46. Detection of stress granules using GFP-tagged G3BP1.

Figure 47:
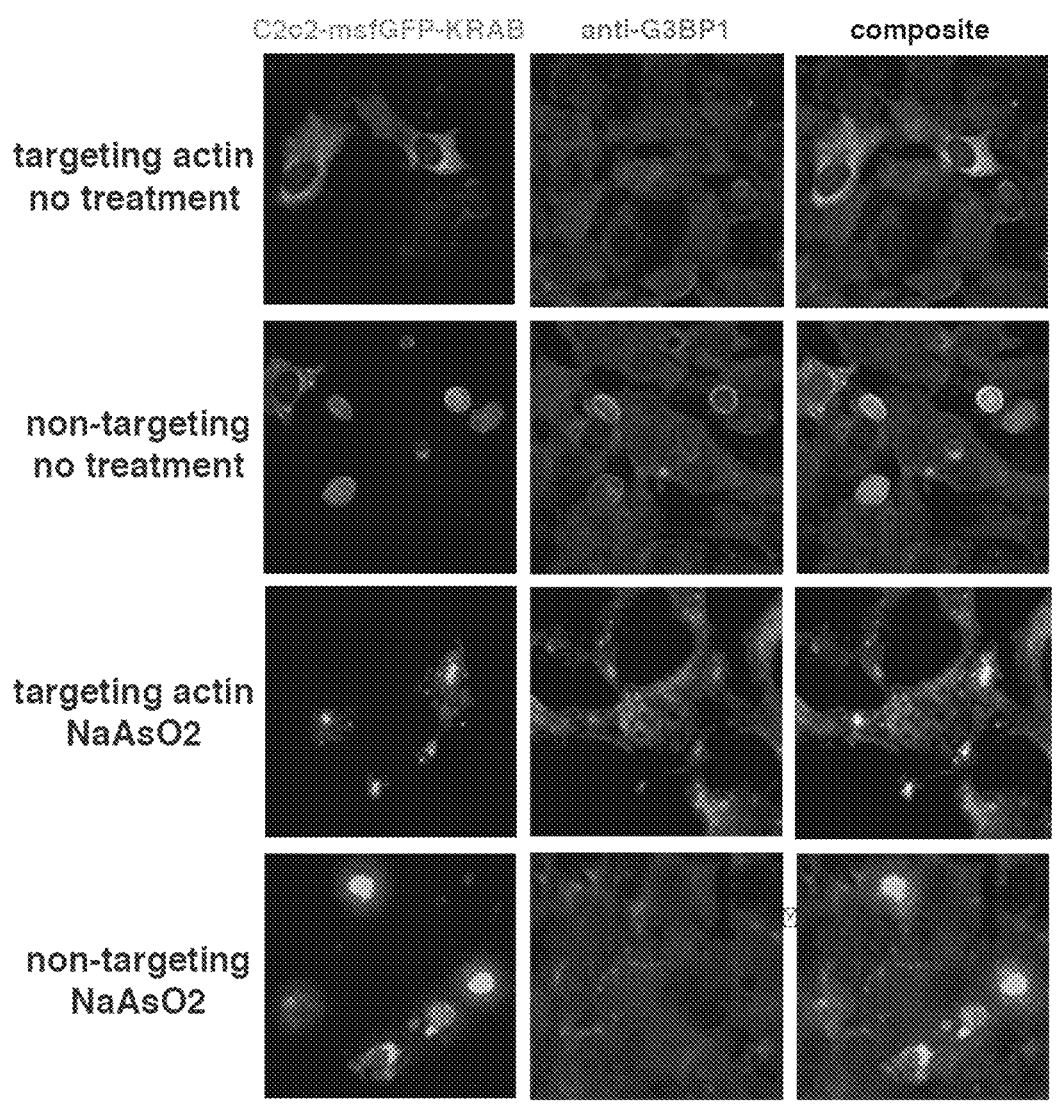

FIG. 47. Detection of acting in stress granules and stress granule substructures ("cores"). Actin mRNA was imaged using C2c2-eGFP-ZF-KRAB, with and without a targeting construct and with or without treatment with NaAsO$_2$ to stabilize core substructures. Stress granules were labeled using anti-G3BP1.

FIG. 48A-48F: dCas13a can image stress granule formation in living cells. (A) Schematic for using the negative-feedback dCas13a-msfGFP-KRAB construct for imaging the localization of β-actin mRNA to stress granules upon treatment with sodium arsenite. (B) Representative fixed immunofluorescence images of 293FT cells treated with 400 µM sodium arsenite. dCas13a-msfGFP-KRAB transfected along with β-actin mRNA targeting guides localizes to stress granules. Shown are representative images of fixed HEK293 cells immunostained with antibodies against the G3BP1 marker for stress granules. (C) Quantification of stress granule localization by Pearson's correlation analysis of ~20 cells per condition. (D) Quantification of stress granule localization by Manders' colocalization analysis of ~20 cells per condition. (E) Representative images from live-cell analysis of stress granule formation in response to 400 uM sodium arsenite treatment. (F) Quantitation of stress granule formation in response to sodium arsenite treatment.

Figure 49A:
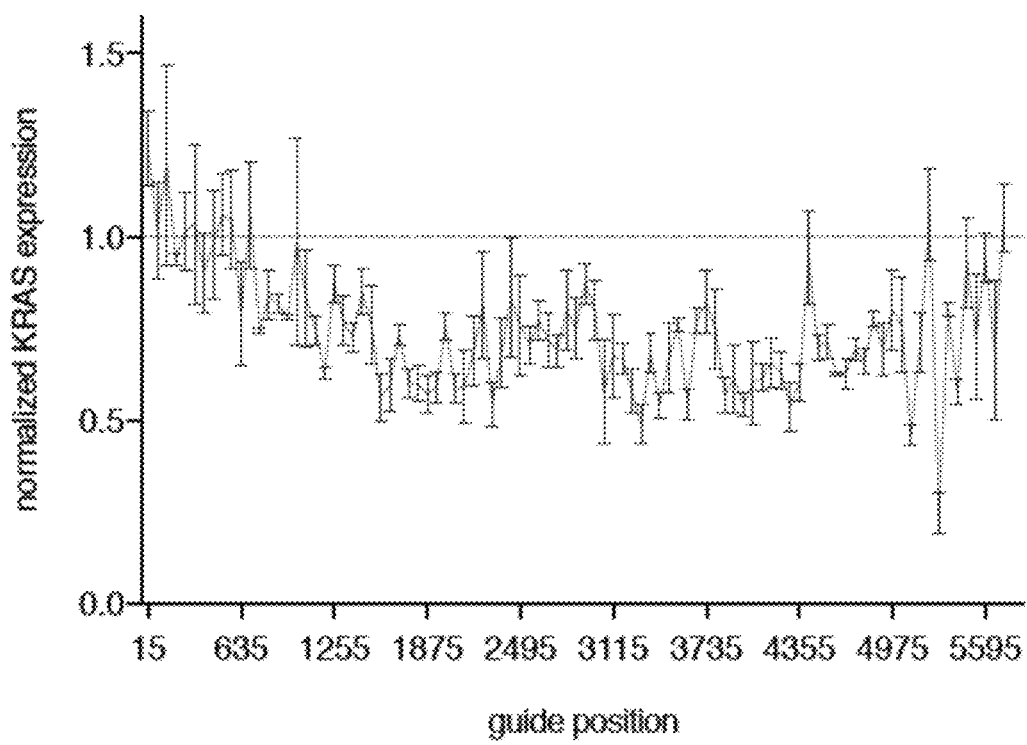
Figure 49B:
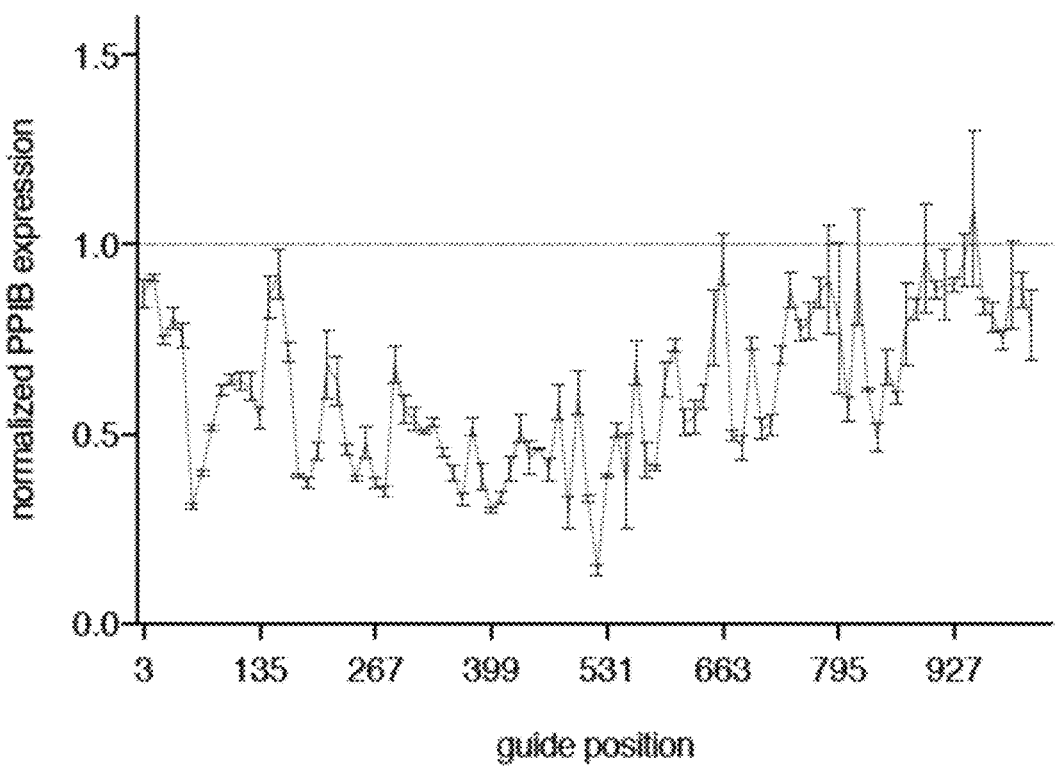
Figures 49C, 49D, 49E, 49F:
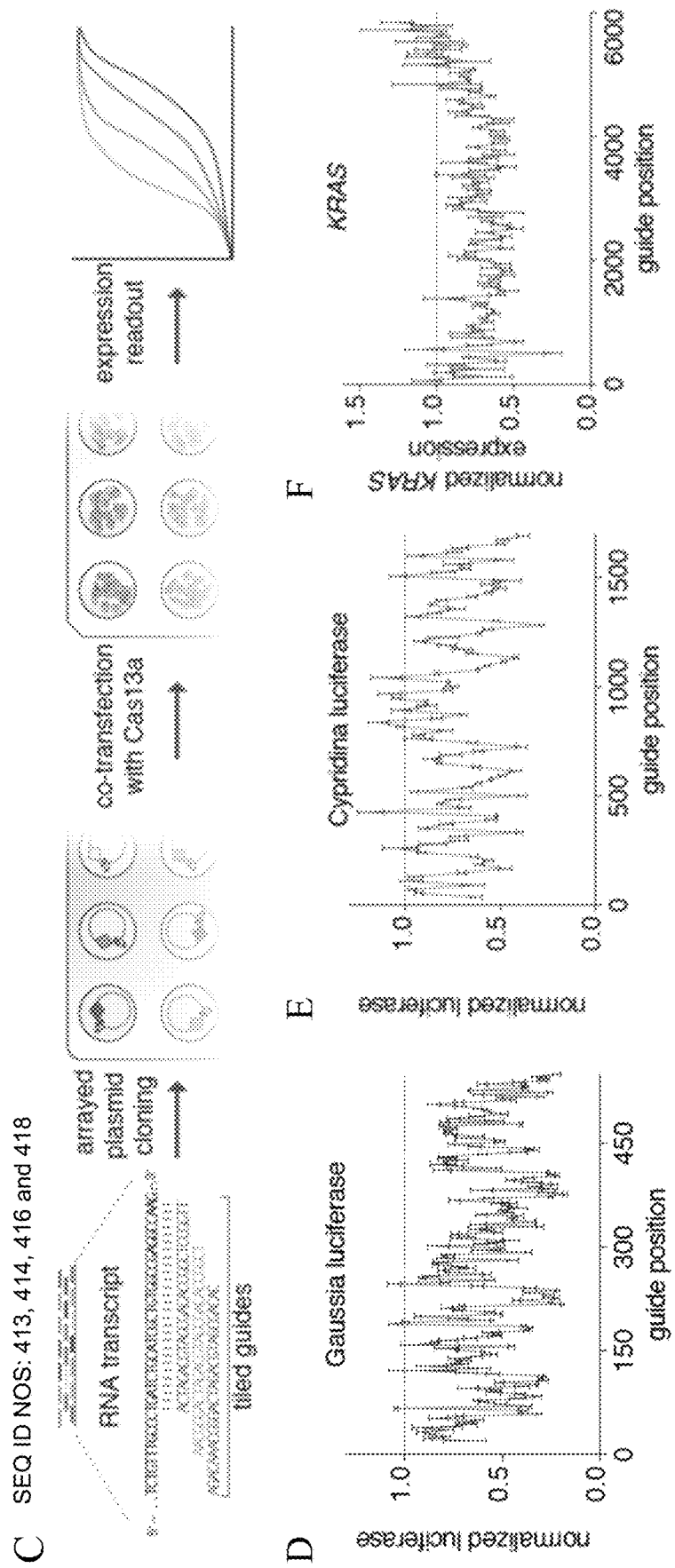
Figures 49G, 49H, 49I, 49J, 49K, 49L:
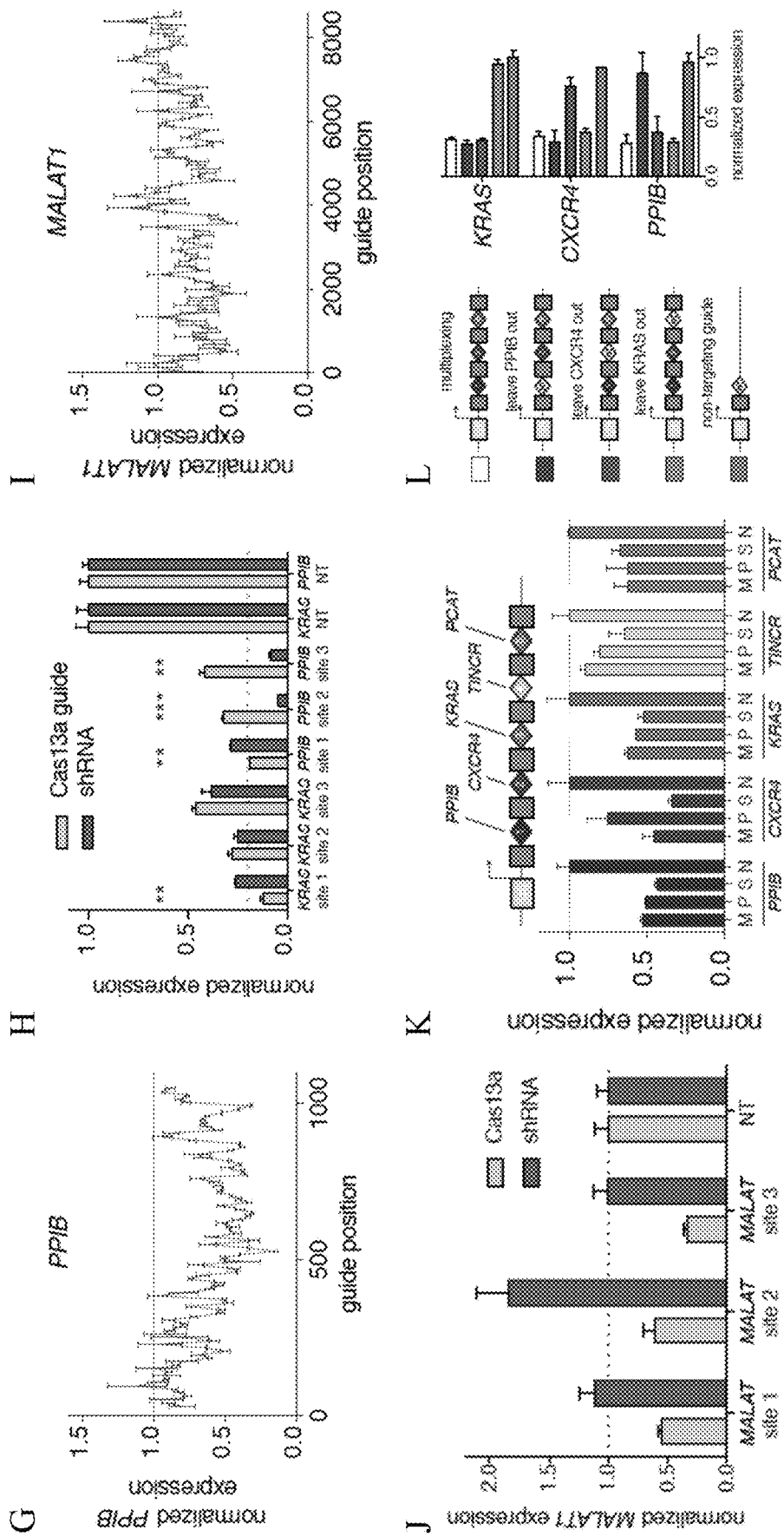
Figure 49M:
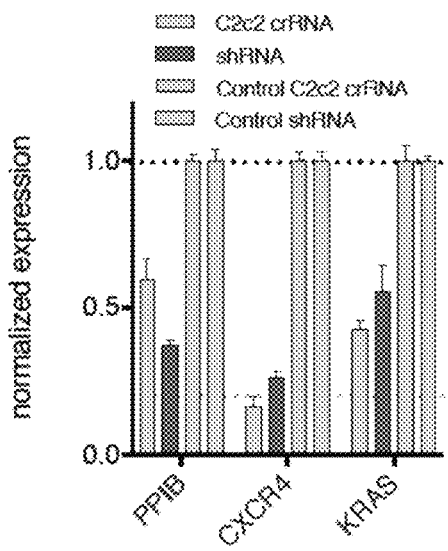
Figure 49N:
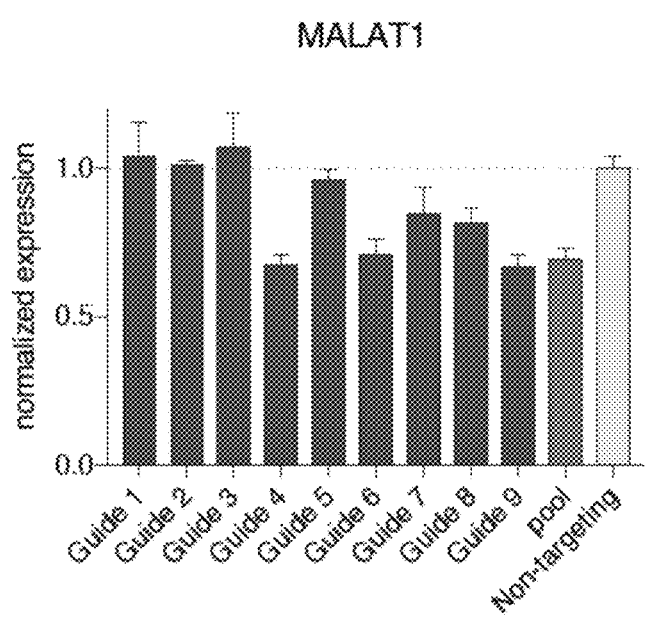
Figure 49O:
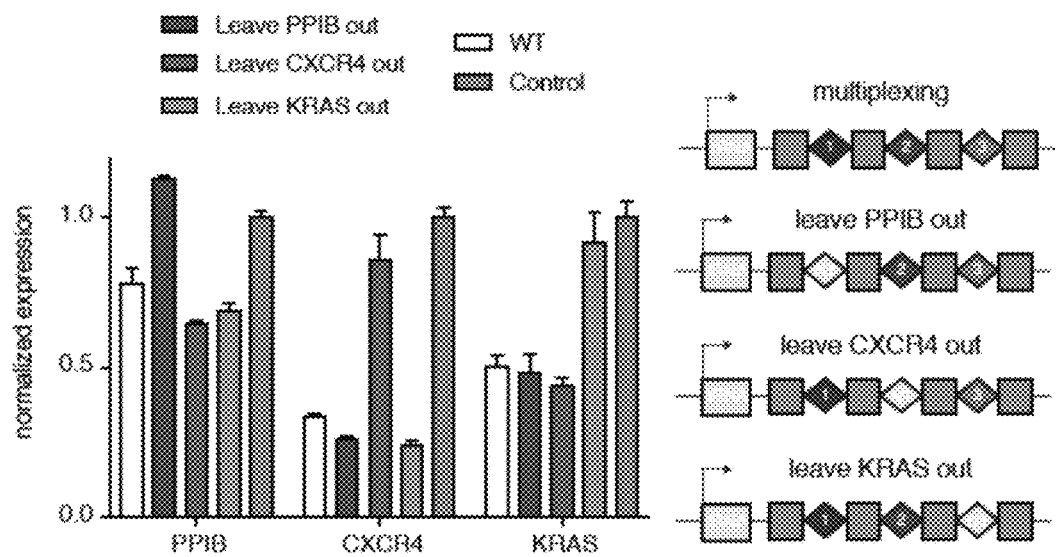

FIG. 49A-49O LwaCas13a can be reprogrammed to target endogenous mammalian coding and non-coding RNA targets. (A) Arrayed knockdown screen of 93 guides evenly tiled across the KRAS transcript. (B) Arrayed knockdown screen of 93 guides evenly tiled across the PPIB transcript. (C) Schematic of LwaCas13a arrayed screening (SEQ ID NOS: 413, 414, 416 and 418, respectively, in order of appearance). (D) Arrayed knockdown screen of 186 guides evenly tiled across the Gluc transcript. (E) Arrayed knockdown screen of 93 guides evenly tiled across the Cypridina luciferase (Cluc) transcript. (F) Arrayed knockdown screen of 93 guides evenly tiled across the KRAS transcript. (G) Arrayed knockdown screen of 93 guides evenly tiled across the PPIB transcript. (H) Validation of the top three guides from the endogenous arrayed knockdown screens with shRNA comparisons. All values are mean±SEM with n=3. *p<0.001; p<0.01. A two-tailed student's T-test was used for comparisons. (I) Arrayed knockdown screen of 93 guides evenly tiled across the MALAT1 transcript. (J) Validation of top three guides from the endogenous arrayed MALAT1 knockdown screen with shRNA comparisons. (K) Multiplexed delivery of five guides in a CRISPR array against five different endogenous genes under the expression of a single promoter is capable of robust knockdown. (L) Multiplexed delivery of three guides against three different endogenous genes or with constructs replacing each of the guides with a non-targeting sequence shows specific knockdown of the genes targeted. All values are mean±SEM with n=3. (M) Knockdown of three different endogenous transcripts with LwaCas13a compared against corresponding RNAi constructs. (N) LwaCas13a is capable of knocking down the nuclear lncRNA transcript MALAT1. (0) Multiplexed delivery of three guides against three different endogenous genes or with constructs replacing each of the crRNAs with a non-targeting sequence shows specific knockdown of the genes targeted.

FIG. 50. HEPN sequence motifs from 21 C2c2 orthologs.

FIG. 51. HEPN sequence motifs from 33 C2c2 orthologs.

Figure 52:
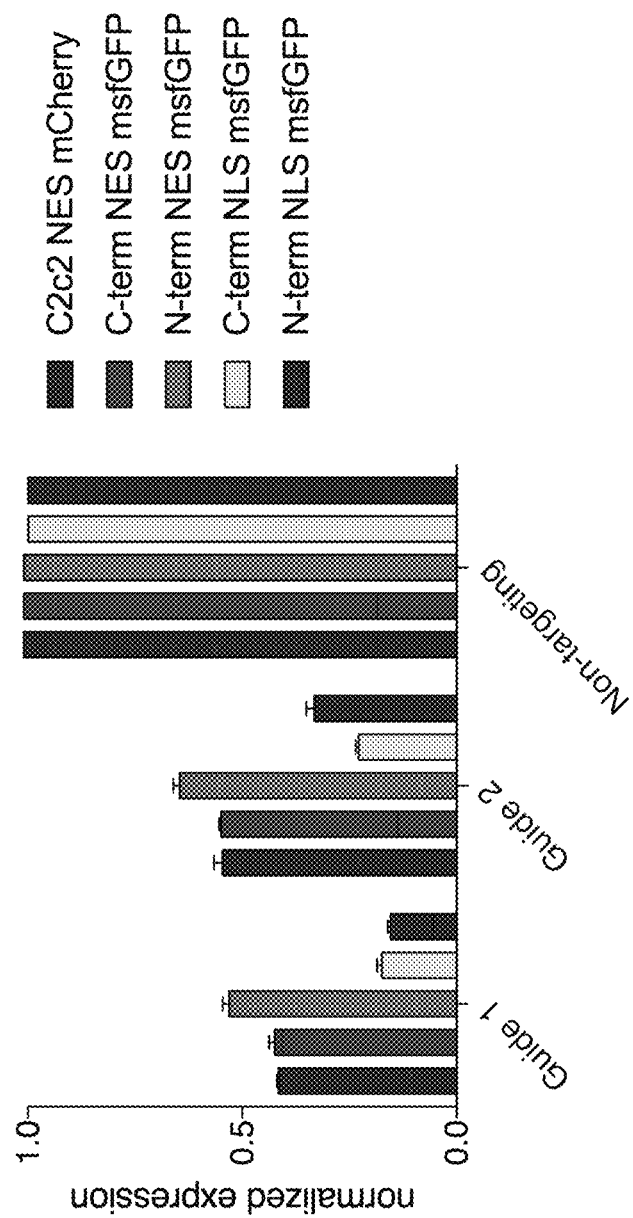

FIG. 52. Exemplary locations for linkage of effector domains. C2c2 proteins linked at the C or N terminus to heterologous functional domains (mCherry and msfGFP depicted) retain function as indicated by luciferase knockdown.

FIG. 53A-53L. (A-K) Sequence alignment of C2c2 orthologs (SEQ ID NOS: 68, 69, 59-61, 80, 62-64, 73, 65, 66, 79, 71, 425 and 67, respectively, in order of appearance). (L) Sequence alignment of HEPN domains (SEQ ID NOS: 547-576, respectively, in order of appearance).

Figure 54:
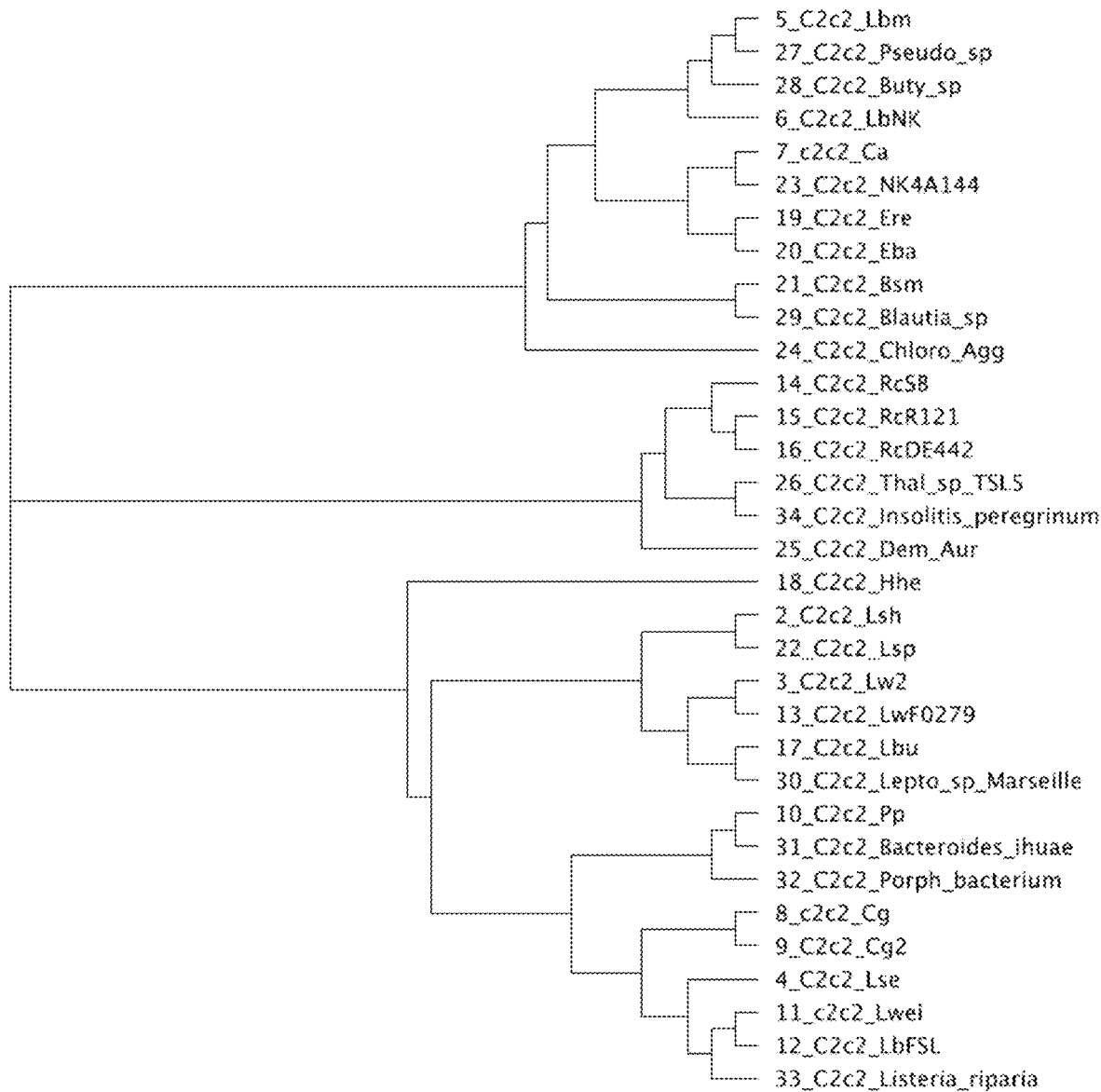

FIG. 54. Tree alignment of C2c2 orthologs.

Figure 55A:
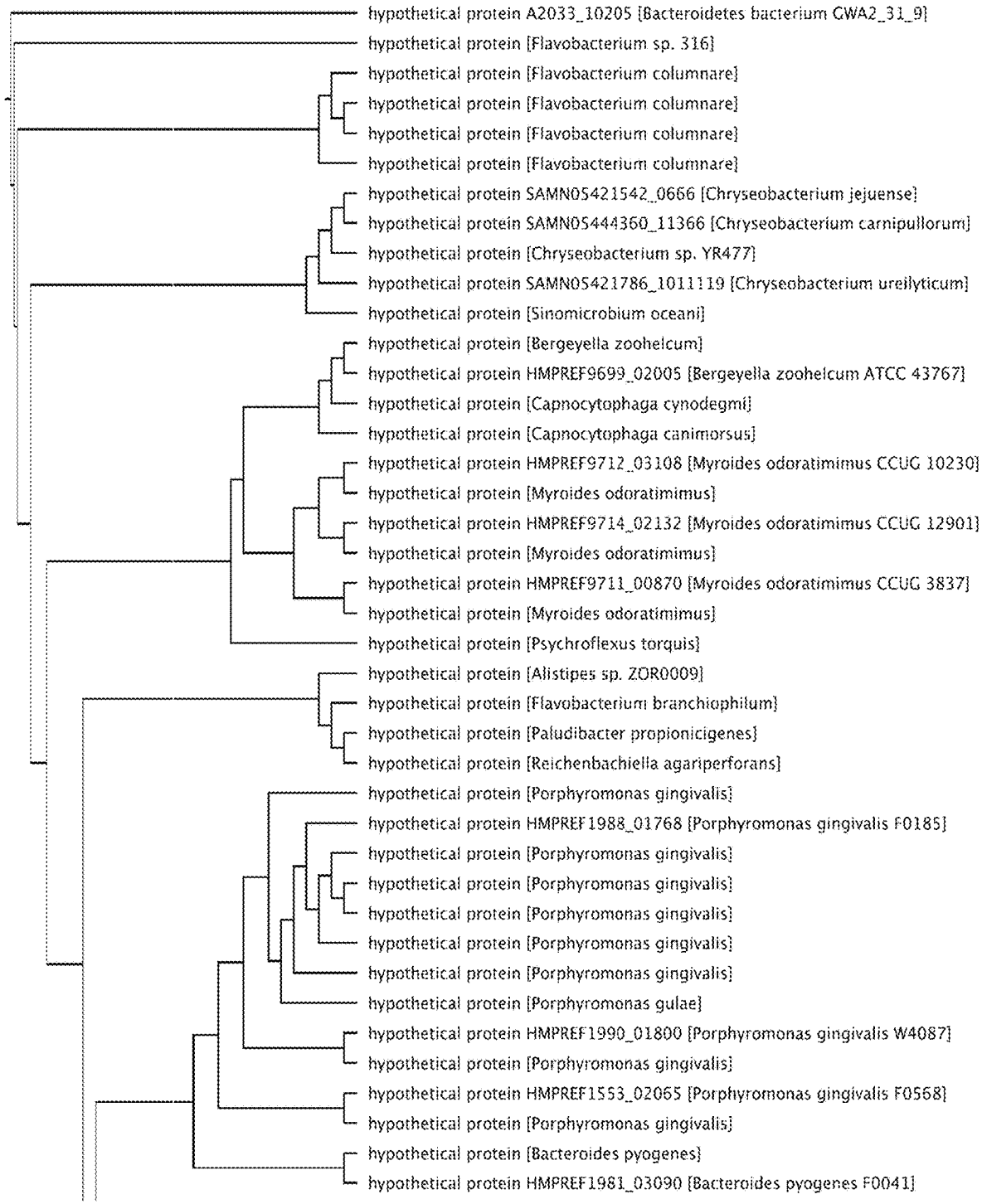
Figure 55B:
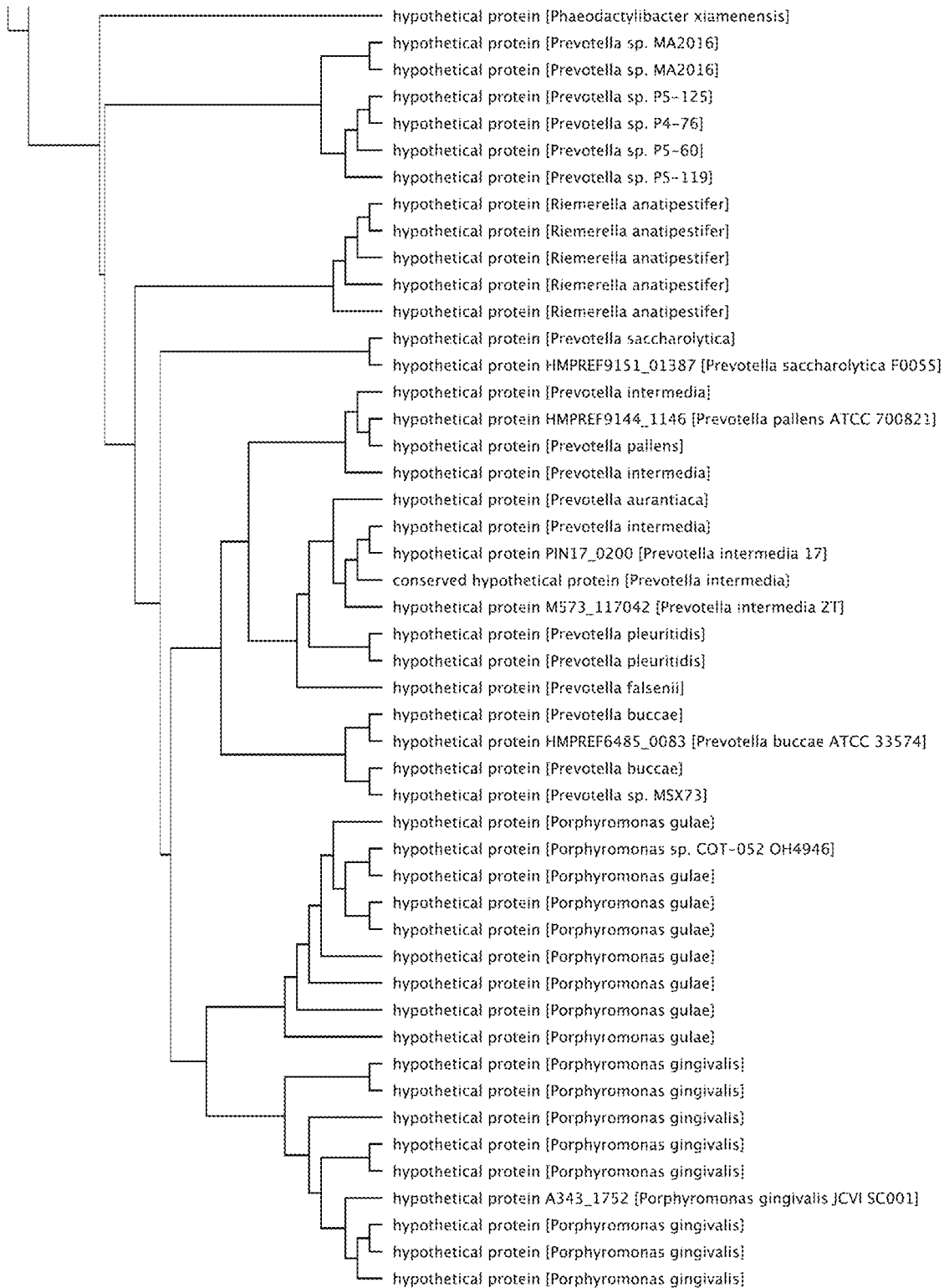

FIG. 55A-55B. Tree alignment of C2c2 and Cas13b orthologs.

FIG. 56A-56F: Engineering and optimization of LwaCas13a for mammalian knockdown. (A) Knockdown of Gluc transcript with Gluc crRNA 1 and varying amounts of transfected LwaCas13a plasmid. (B) Knockdown of Gluc transcript by LwaCas13a and varying amounts of transfected Gluc crRNA 1 and 2 plasmid. (C) Knockdown of Gluc transcript using crRNAs expressed from either U6 or tRNAVal promoters. (D) Knockdown of KRAS transcript using crRNAs expressed from either U6 or tRNAVal promoters. (E) Knockdown of KRAS transcript using guides expressed from either U6 or tRNA$^{Val}$ promoters. (F) Arrayed knockdown screen of 93 guides evenly tiled across the XIST transcript.

FIG. 57A-57E: Evaluation of LwaCas13a PFS preferences and comparisons to LshCas13a. (A) Sequence comparison tree of the fifteen Cas13a orthologs evaluated in this study. (B) Number of LshCas13a and LwaCas13a PFS sequences above depletion threshold for varying depletion thresholds. (C) Distributions of PFS enrichment for LshCas13a and LwaCas13a in targeting samples, normalized to non-targeting samples. (D) Sequence logos and counts for remaining PFS sequences after LshCas13a cleavage at varying enrichment cutoff thresholds. (E) Sequence logos and counts for remaining PFS sequences after LwaCas13a cleavage at varying enrichment cutoff thresholds.

FIG. 58A-58D: LwaCas13a targeting efficiency is influenced by accessibility along the transcript. (A) First row: Top knockdown guides are plotted by position along target transcript. The top 20% of guides are chosen for Gluc and top 30% of guides for Cluc, KRAS, and PPIB. Second row: Histograms for the pairwise distance between adjacent top guides for each transcript (blue) compared to a random null-distribution (red). Inset shows the cumulative frequency curves for these histograms. A shift of the blue curve (actual measured distances) to the left of the red curve (null distribution of distances) indicates that guides are closer together than expected by chance. (B) Gluc, Cluc, PPIB, and KRAS knockdown partially correlates with target accessibility as measured by predicted folding of the transcript. (C) Kernel density estimation plots depicting the correlation between target accessibility (probability of a region being base-paired) and target expression after knockdown by LwaCas13a. (D) First row: Correlations between target expression and target accessibility (probability of a region being base-paired) measured at different window sizes (W) and for different k-mer lengths. Second row: P-values for the correlations between target expression and target accessibility (probability of a region being base-paired) measured at different window sizes (W) and for different k-mer lengths. The color scale is designed such that p-values >0.05 are shades of red and p-values <0.05 are shades of blue.

FIG. 59A-59K: Detailed evaluation of LwaCas13a sensitivity to mismatches in the crRNA:target duplex at varying spacer lengths. (A) Knockdown of KRAS evaluated with crRNAs containing single mismatches at varying positions across the spacer sequence. (B) Knockdown of PPIB evaluated with crRNAs containing single mismatches at varying positions across the spacer sequence. (C) Knockdown of Gluc evaluated with guides containing non-consecutive double mismatches at varying positions across the spacer sequence. The wild-type sequence is shown at the top with mismatch identities shown below. Figure discloses SEQ ID NOS: 426-450, respectively, in order of appearance. (D) Collateral cleavage activity on ssRNA 1 and 2 for varying spacer lengths. (n=4 technical replicates; bars represent mean±s.e.m.). (E) Specificity ratios of crRNA tested in (D). Specificity ratios are calculated as the ratio of the on-target RNA (ssRNA 1) collateral cleavage to the off-target RNA (ssRNA 2) collateral cleavage. (n=4 technical replicates; bars represent mean±s.e.m.). (F) Collateral cleavage activity on ssRNA 1 and 2 for 28 nt spacer crRNA with synthetic mismatches tiled along the spacer. (n=4 technical replicates; bars represent mean±s.e.m.). (G) Specificity ratios of crRNA tested in (F). Specificity ratios are calculated as the ratio of the on-target RNA (ssRNA 1) collateral cleavage to the off-target RNA (ssRNA 2) collateral cleavage. (n=4 technical replicates; bars represent mean±s.e.m.). (H) Collateral cleavage activity on ssRNA 1 and 2 for 23 nt spacer crRNA with synthetic mismatches tiled along the spacer. (n=4 technical replicates; bars represent mean±s.e.m.). (I) Specificity ratios of crRNA tested in (H). Specificity ratios are calculated as the ratio of the on-target RNA (ssRNA 1) collateral cleavage to the off-target RNA (ssRNA 2) collateral cleavage. (n=4 technical replicates; bars represent mean±s.e.m.). (J) Collateral cleavage activity on ssRNA 1 and 2 for 20 nt spacer crRNA with synthetic mismatches tiled along the spacer. (n=4 technical replicates; bars represent mean±s.e.m.). (K) Specificity ratios of crRNA tested in (J). Specificity ratios are calculated as the ratio of the on-target RNA (ssRNA 1) collateral cleavage to the off-target RNA (ssRNA 2) collateral cleavage. (n=4 technical replicates; bars represent mean±s.e.m.)

FIG. 60A-60F: LwaCas13a is more specific than shRNA knockdown on endogenous targets and has little variation comparable to biological noise. (A) Left: Expression levels in log 2(transcripts per million (TPM)) values of all genes detected in RNA-seq libraries of non-targeting shRNA-transfected control (x-axis) compared to KRAS-targeting shRNA (y-axis). Shown is the mean of three biological replicates. The KRAS transcript data point is colored in red. Right: Expression levels in log 2(transcripts per million (TPM)) values of all genes detected in RNA-seq libraries of non-targeting LwaCas13a-crRNA-transfected control (x-axis) compared to KRAS-targeting LwaCas13a-crRNA (y-axis). Shown is the mean of three biological replicates. The KRAS transcript data point is colored in red. (B) Left: Expression levels in log 2(transcripts per million (TPM)) values of all genes detected in RNA-seq libraries of non-targeting shRNA-transfected control (x-axis) compared to PPIB-targeting shRNA (y-axis). Shown is the mean of three biological replicates. The PPIB transcript data point is colored in red. Right: Expression levels in log 2(transcripts per million (TPM)) values of all genes detected in RNA-seq libraries of non-targeting LwaCas13a-crRNA-transfected control (x-axis) compared to PPIB-targeting LwaCas13a-crRNA (y-axis). Shown is the mean of three biological replicates. The PPIB transcript data point is colored in red. (C) Comparisons of individual replicates of non-targeting shRNA conditions (first row) and Gluc-targeting shRNA conditions (second row). (D) Comparisons of individual replicates of non-targeting crRNA conditions (first row) and Gluc-targeting crRNA conditions (second row). (E) Pairwise comparisons of individual replicates of non-targeting shRNA conditions against the Gluc-targeting shRNA conditions. (F) Pairwise comparisons of individual replicates of non-targeting crRNA conditions against the Gluc-targeting crRNA conditions.

Figures 61A, 61B:
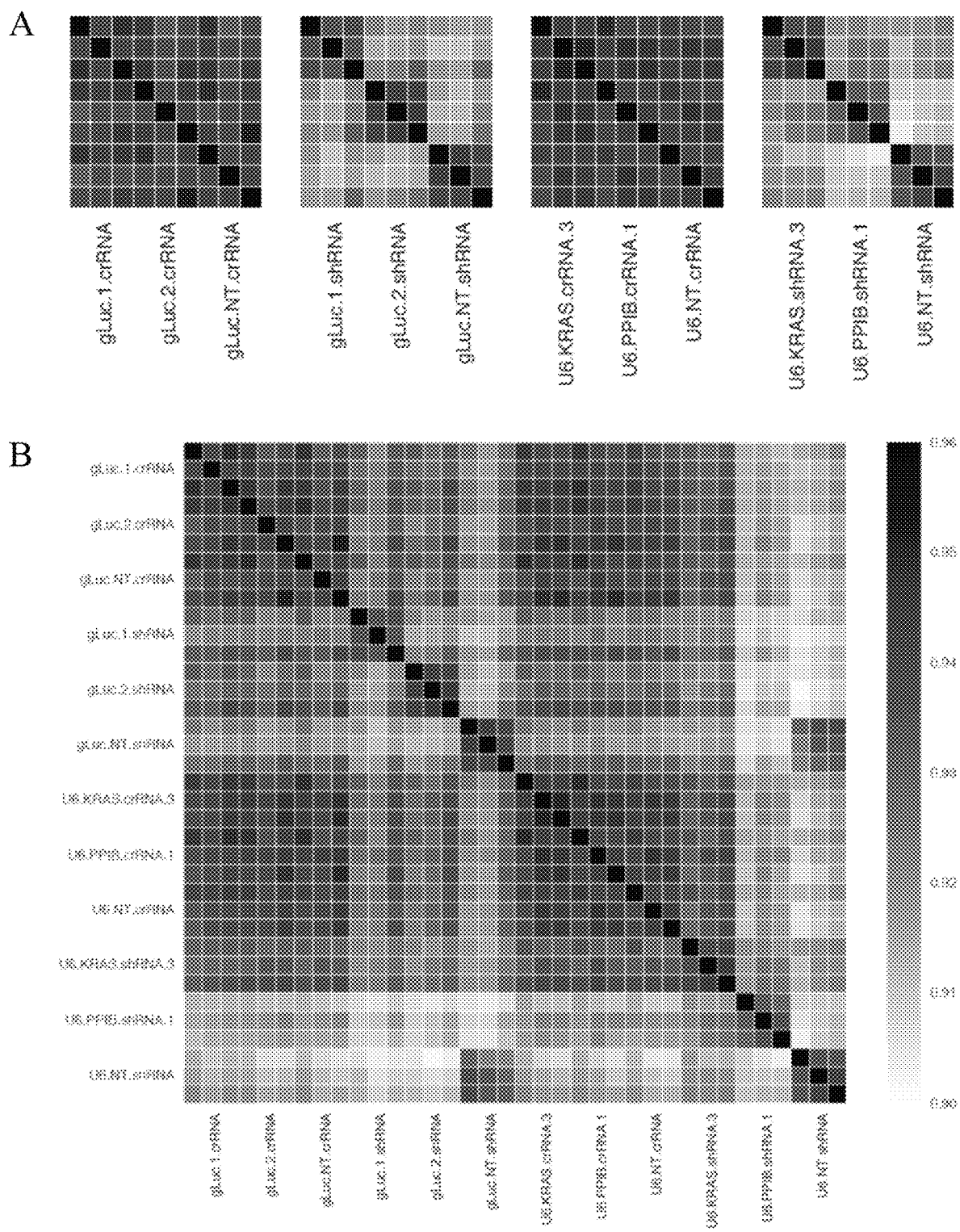
Figure 61C:
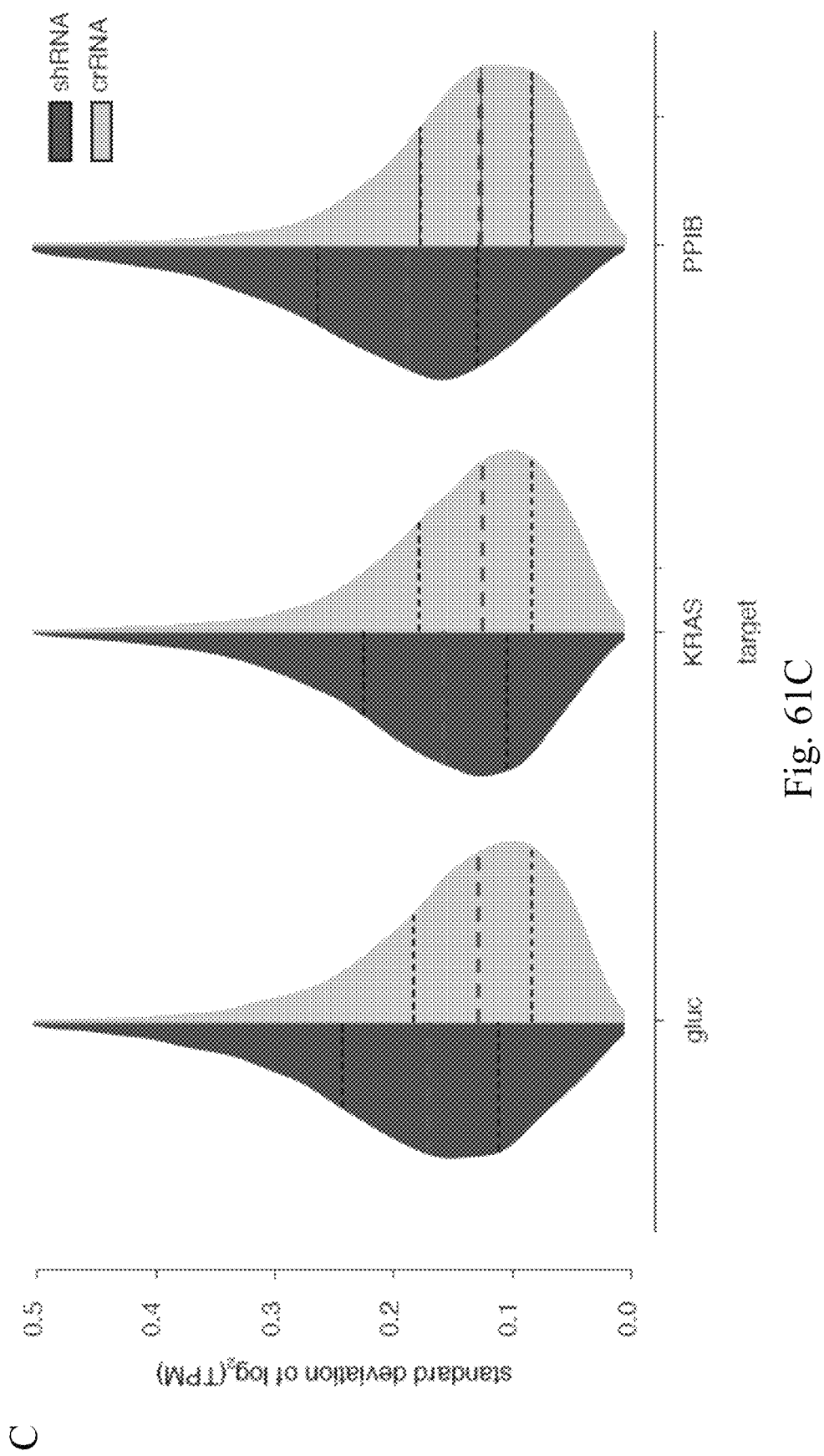

FIG. 61A-61C: Detailed analysis of LwaCas13a and RNAi knockdown variability (standard deviation) across all samples. (A) Heatmap of correlations (Kendall's tau) for log 2(transcripts per million (TPM+1)) values of all genes detected in RNA-seq libraries between targeting and non-targeting replicates for shRNA or crRNA targeting either luciferase reporters or endogenous genes. (B) Heatmap of correlations (Kendall's tau) for log 2(transcripts per million (TPM+1)) values of all genes detected in RNA-seq libraries between all replicates and perturbations. (C) Distributions of standard deviations for log 2(transcripts per million (TPM+1)) values of all genes detected in RNA-seq libraries among targeting and non-targeting replicates for each gene targeted for either shRNA or crRNA.

FIG. 62A-62J: LwaCas13a knockdown is specific to the targeted transcript with no activity on a measured off-target transcript. (A) Heatmap of absolute Gluc signal for first 96 spacers tiling Gluc. (B) Heatmap of absolute Cluc signal for first 96 spacers tiling Gluc. (C) Relationship between absolute Gluc signal and normalized luciferase for Gluc tiling guides. (D) Relationship between absolute Cluc signal and normalized luciferase for Gluc tiling guides. (E) Relationship between absolute Cluc signal and normalized luciferase for Cluc tiling guides. (F) Relationship between absolute Gluc signal and normalized luciferase for Cluc tiling guides. (G) Relationship between PPIB 2-Ct levels and PPIB knockdown for PPIB tiling guides. (H) Relationship between GAPDH 2-Ct levels and PPIB knockdown for PPIB tiling guides. (I) Relationship between KRAS 2-Ct levels and KRAS knockdown for PPIB KRAS guides. (J) Relationship between GAPDH 2-Ct levels and KRAS knockdown for PPIB KRAS guides.

FIG. 63A-63F: dCas13a represses reporter gene expression and binds endogenous genes. (A) dCas13a tiled across a synthetic HBG1 intron separating Cluc and Gluc is capable of repressing Gluc translation at specific distances from the translation initiation site. (B) RNA immunoprecipitation enrichment of the β-actin mRNA targeted with dCas13a and two targeting crRNAs and one non-targeting crRNA. (C) Comparison between localization of dCas13-GFP and dCas13a-GFP-KRAB constructs for imaging ACTB. (D) Additional fields of view of the dCas13a-NLS-msfGFP negative-feedback construct delivered with a non-targeting guide. (E) Additional fields of view of the dCas13a-NLS-msfGFP negative-feedback construct delivered with ACTB guide. (F) Additional fields of view of the dCas13a-NLS-msfGFP negative-feedback construct delivered with ACTB guide.

Figure 64A:
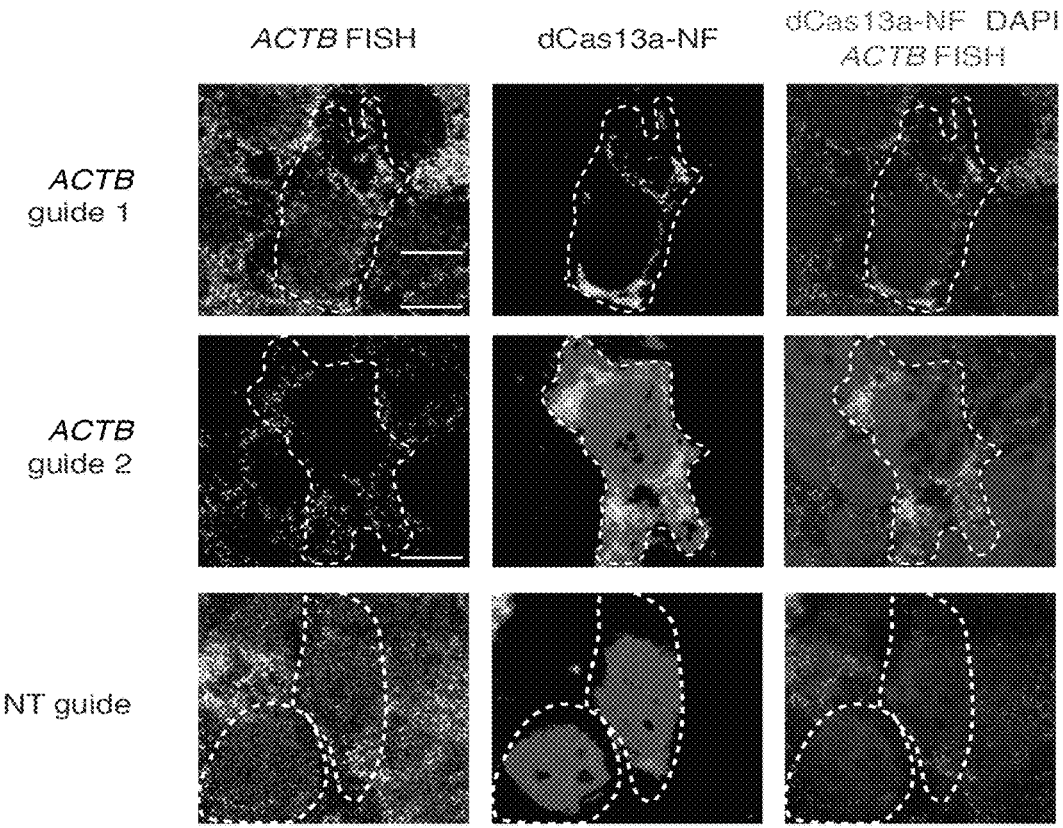
Figure 64B:
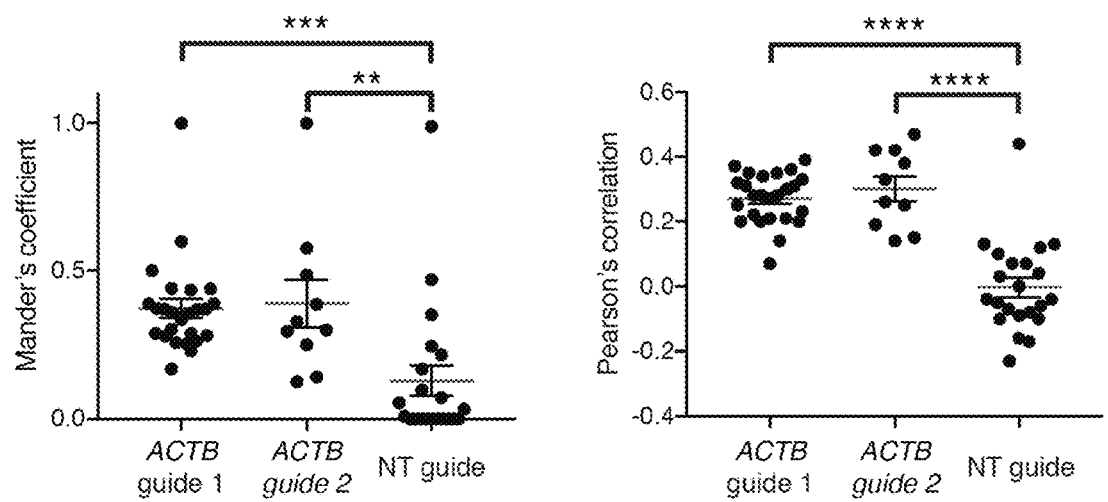

FIG. 64A-64B dCas13a-NF can image stress granule formation in living cells. (A) Representative images from RNA FISH of the ACTB transcript in dCas13a-NF-expressing cells with corresponding ACTB-targeting and non-targeting guides. Cell outline is shown with a dashed line. (B) Overall signal overlap between ACTB RNA FISH signal and dCas13a-NF quantified by the Mander's overlap coefficient (left) and Pearson's correlation (right). Correlations and signal overlap are calculated pixel-by-pixel on a per cell basis. All values are mean±SEM with n=3. **$p<0.0001$; *$p<0.001$; **$p<0.01$. A two-tailed student's T-test was used for comparisons.

Figure 65A:
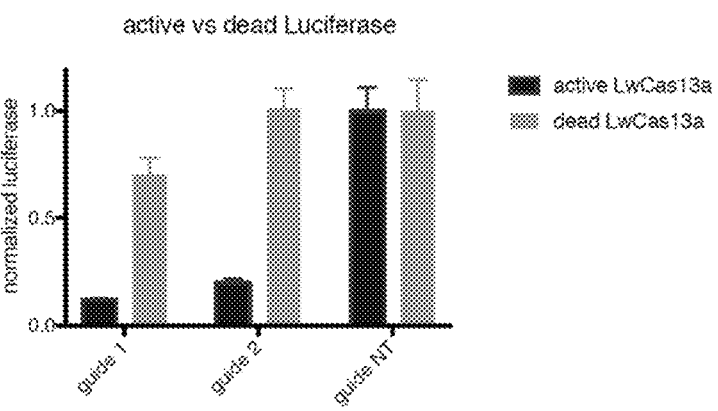
Figure 65B:
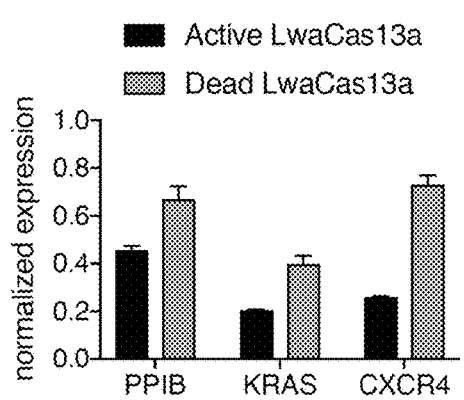
Figure 65C:
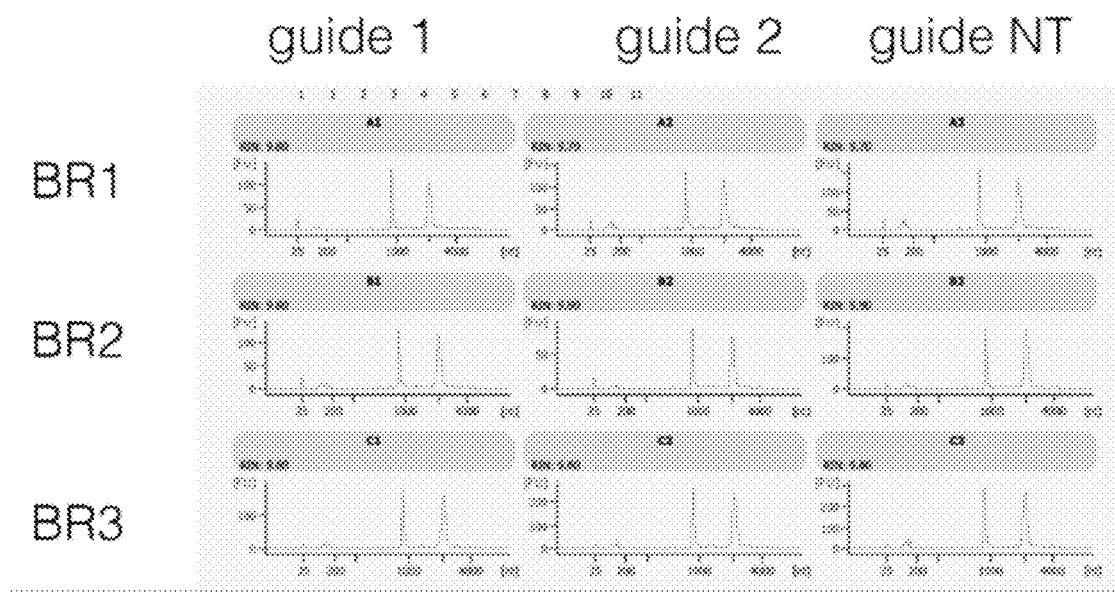

FIG. 65A-65C. Direct and collateral transcript knockdown of expression. (A) Knockdown of luciferase by active v. dead Cas13a. (B) Active vs dead Cas13a knockdown of endogenous gene expression. Knockdown by dead Cas13a can be due to blocking of translation or destabilizing of transcripts due to binding. (C) Absence of collateral activity by dead Cas13a in mammalian cells. Using dead Cas13a and guides 1 and 2 against luciferase in (A), no change in the transcript distribution size is observed compared to a non-targeting control.

Figure 66A:
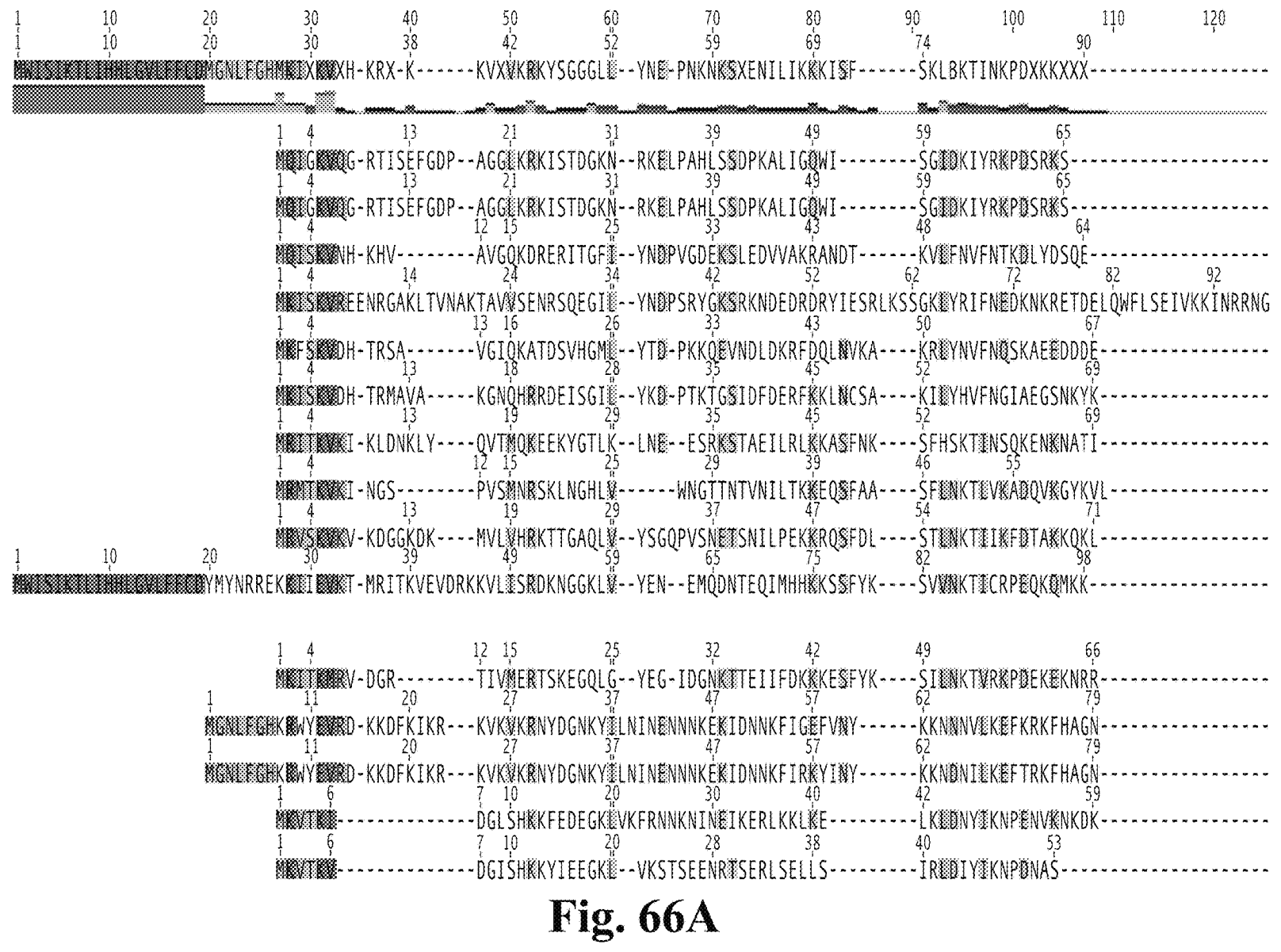
Figure 66B:
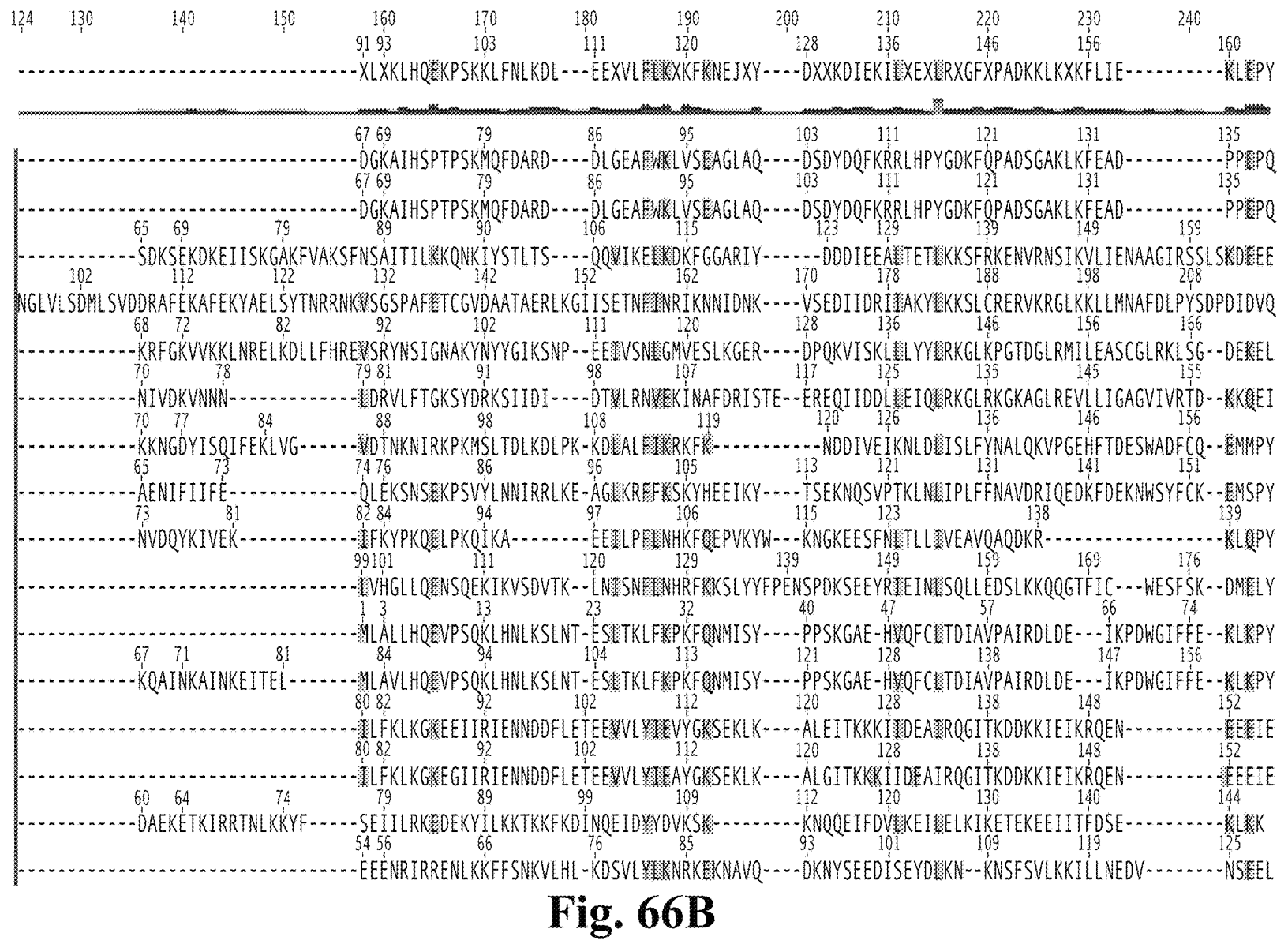
Figure 66C:
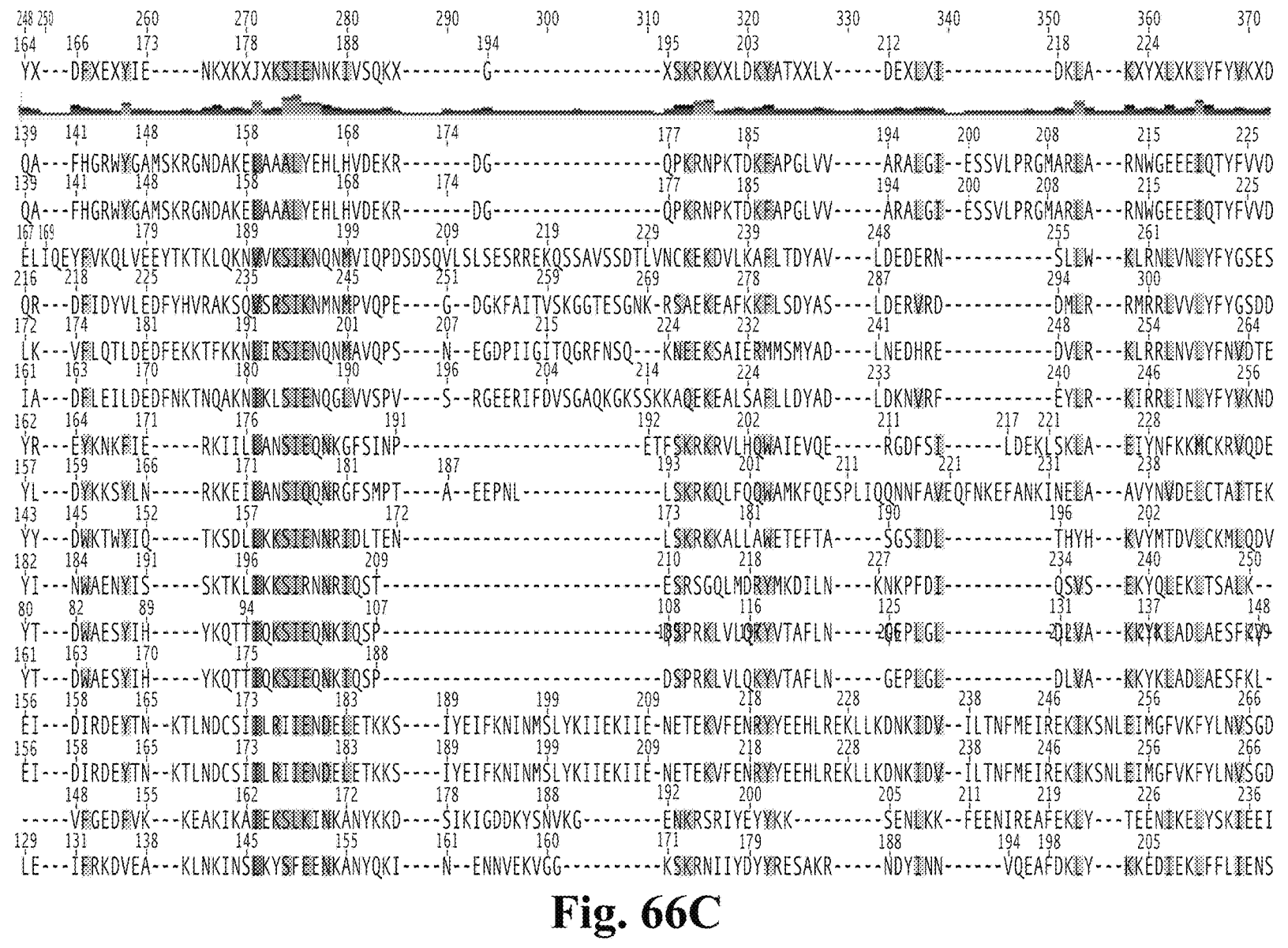
Figure 66D:
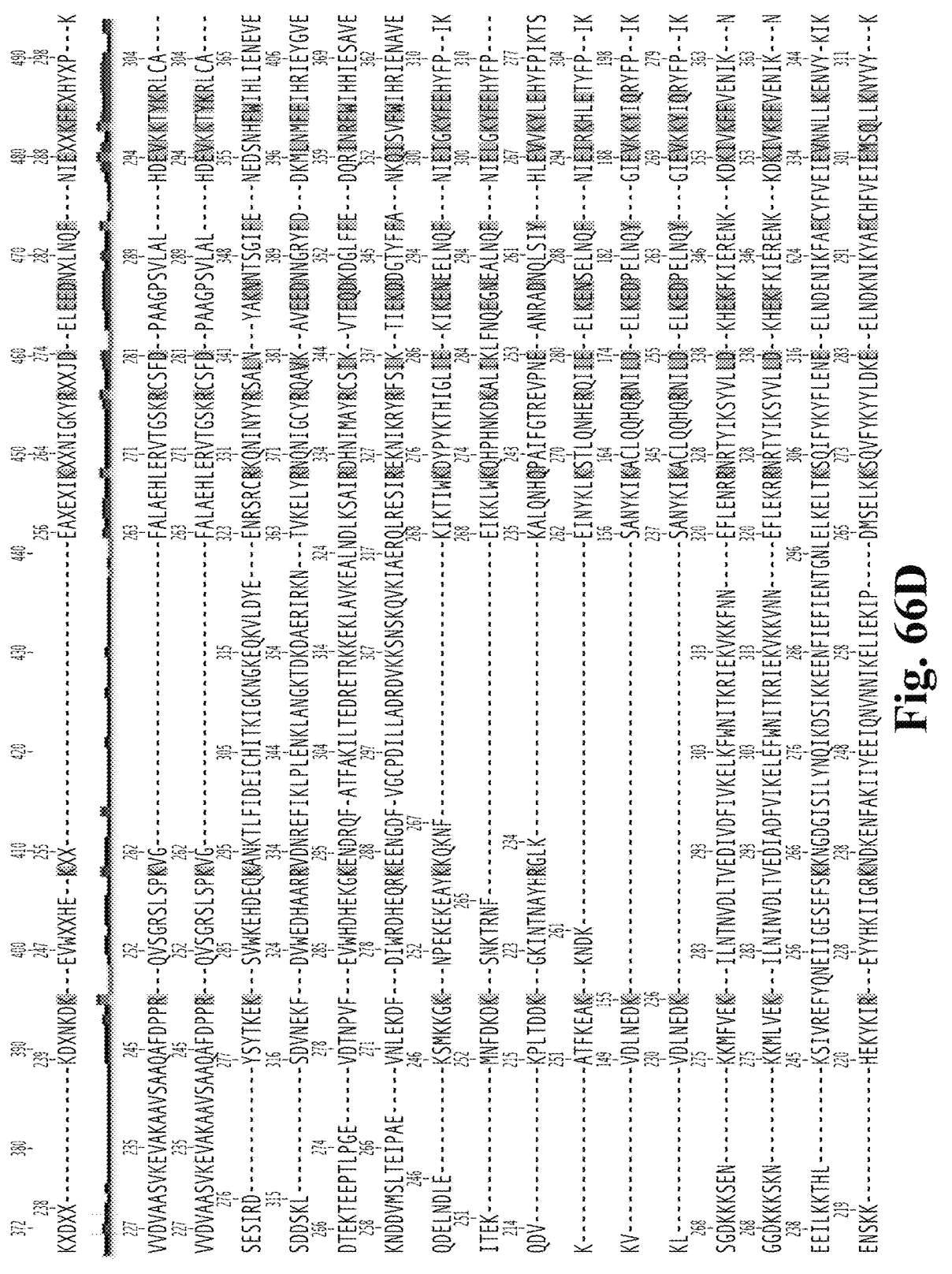
Figure 66E:
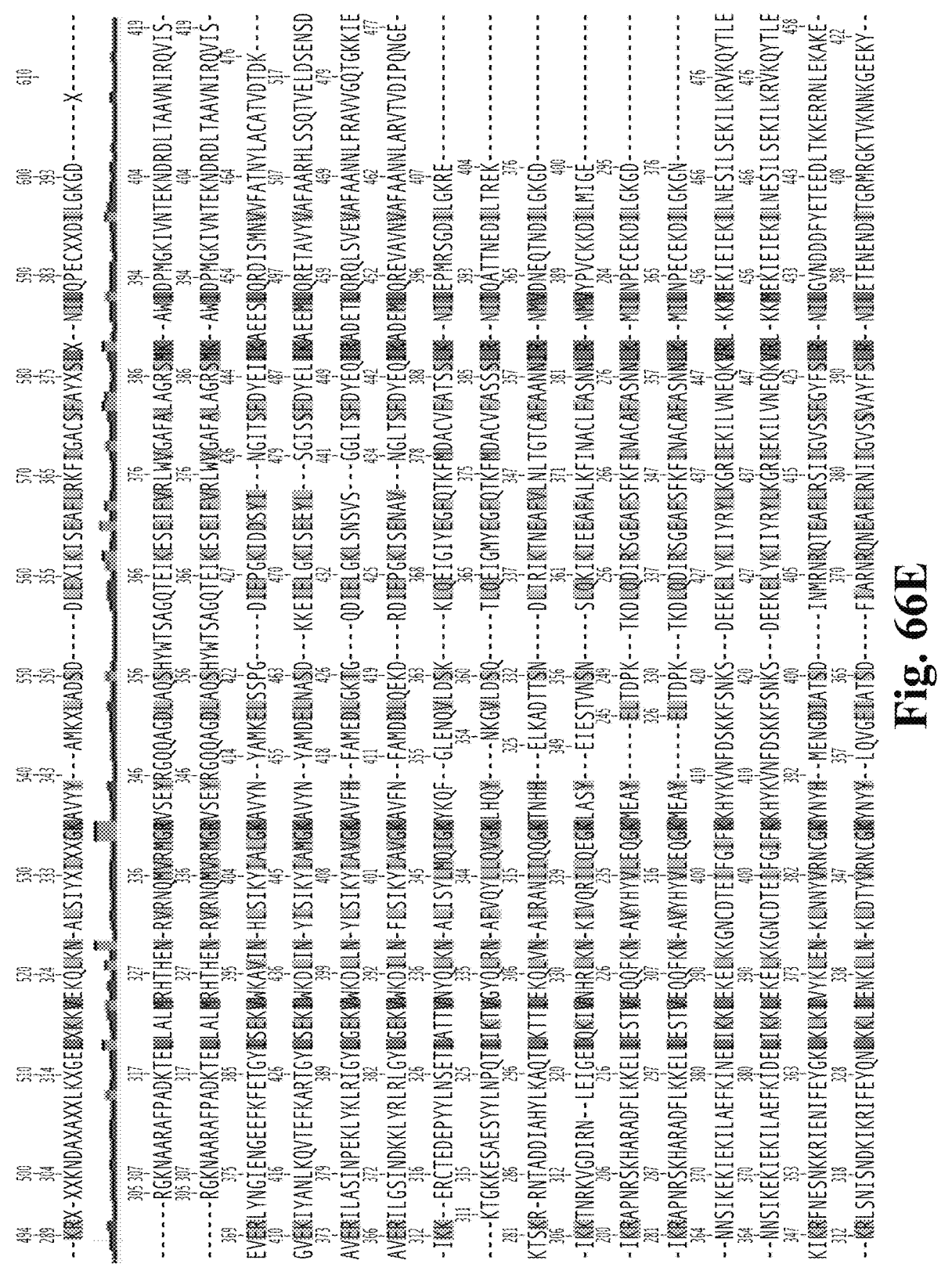
Figure 66F:
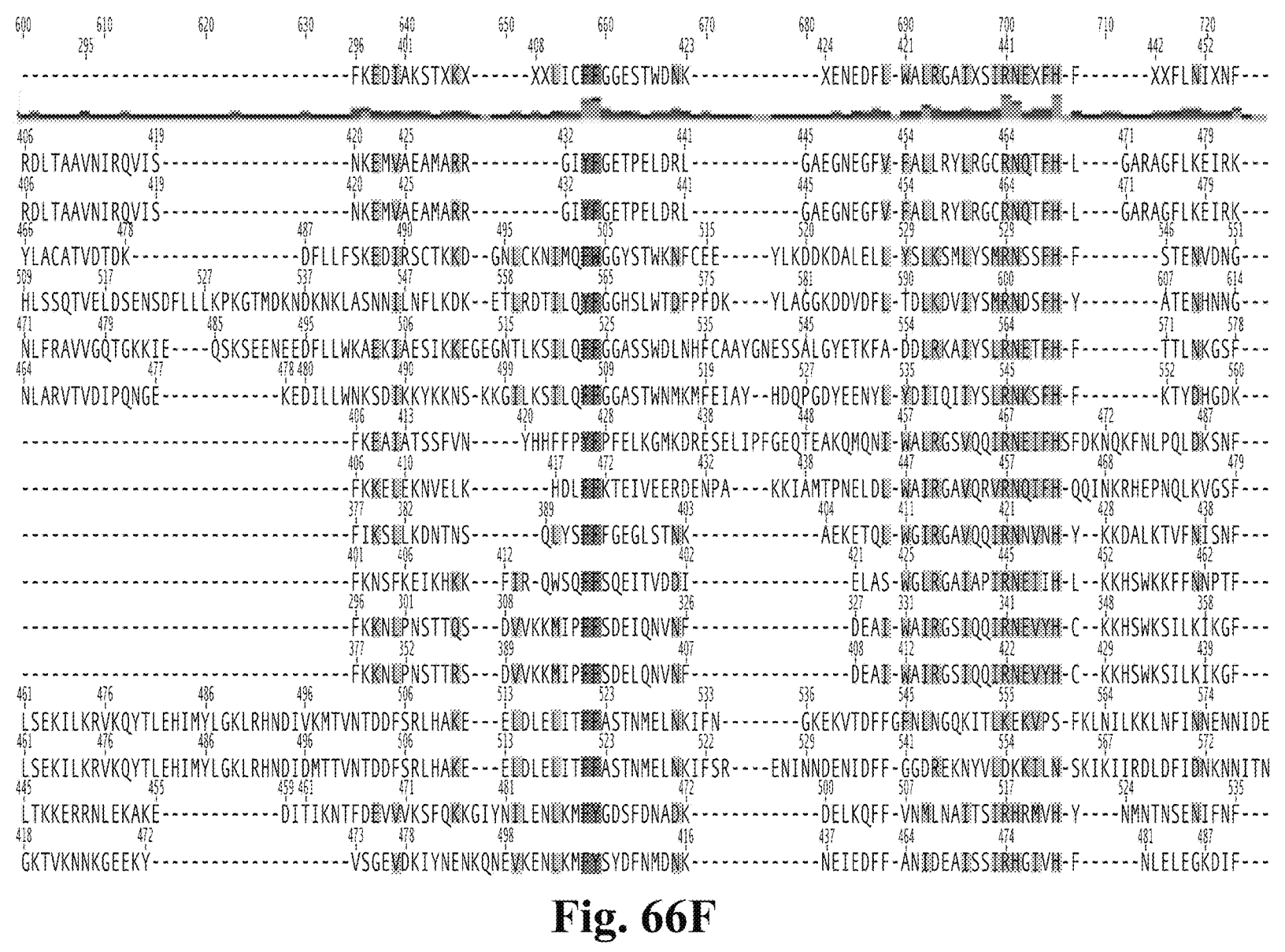
Figure 66G:
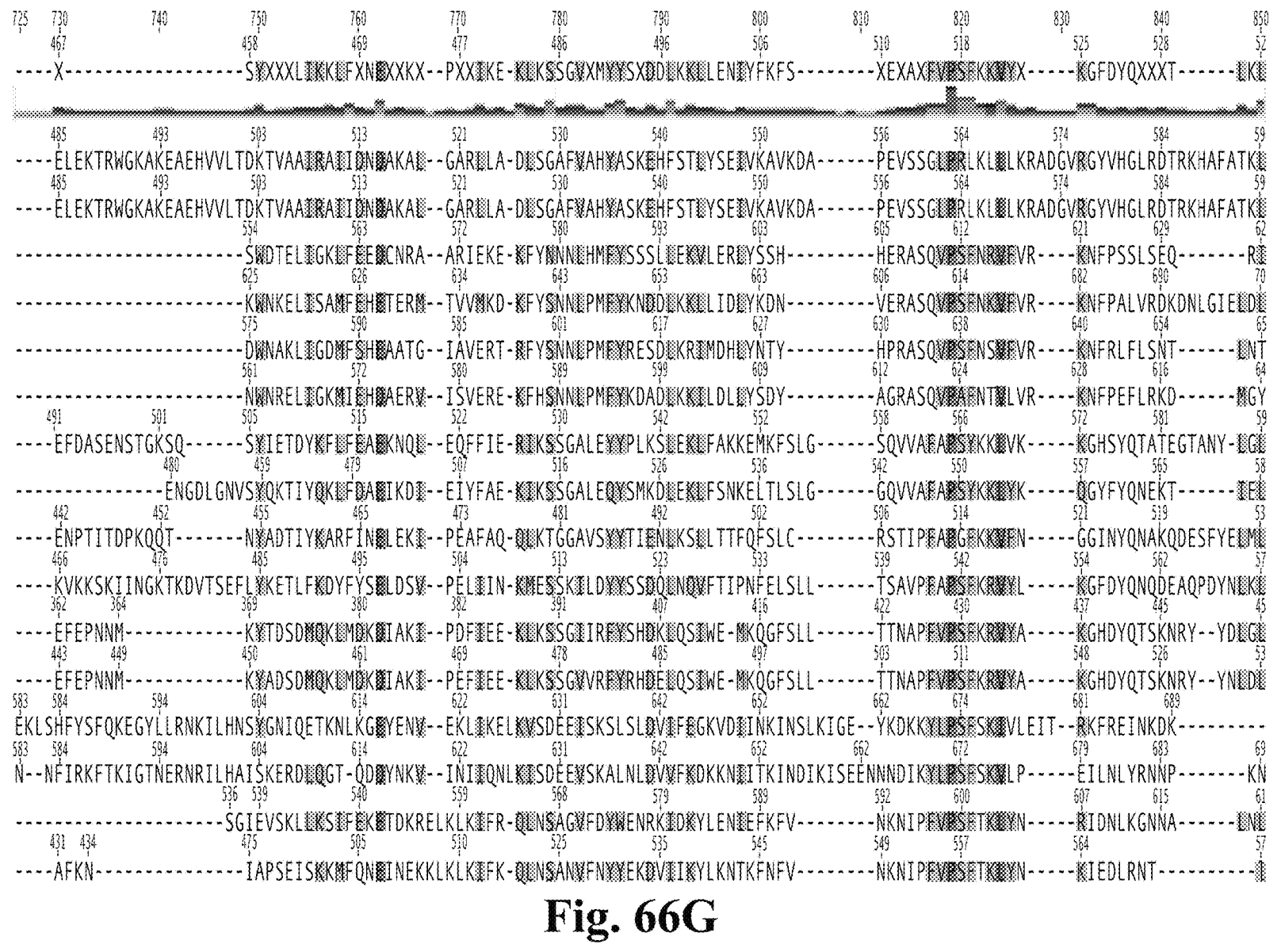
Figure 66H:
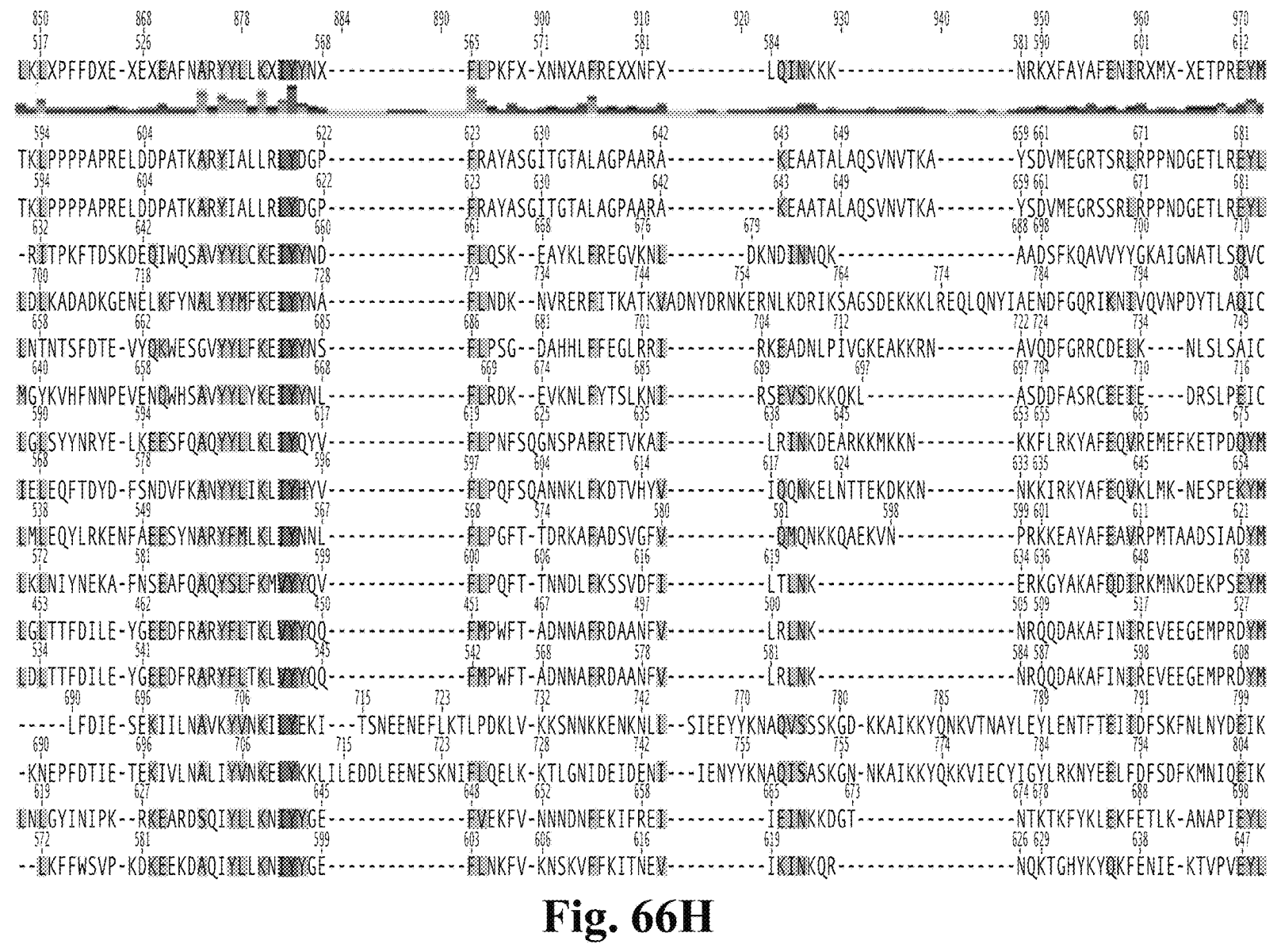
Figure 66I:
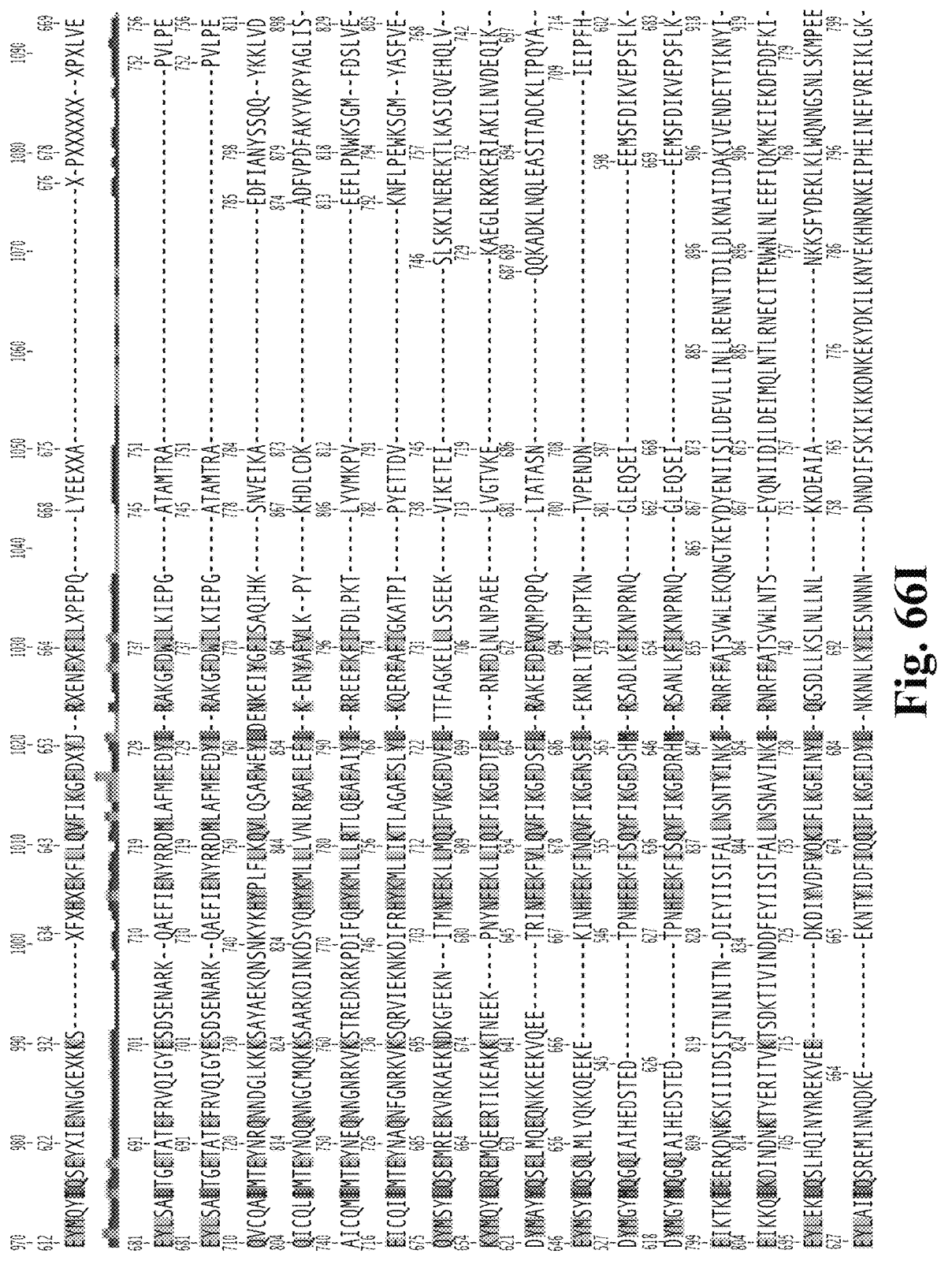
Figure 66J:
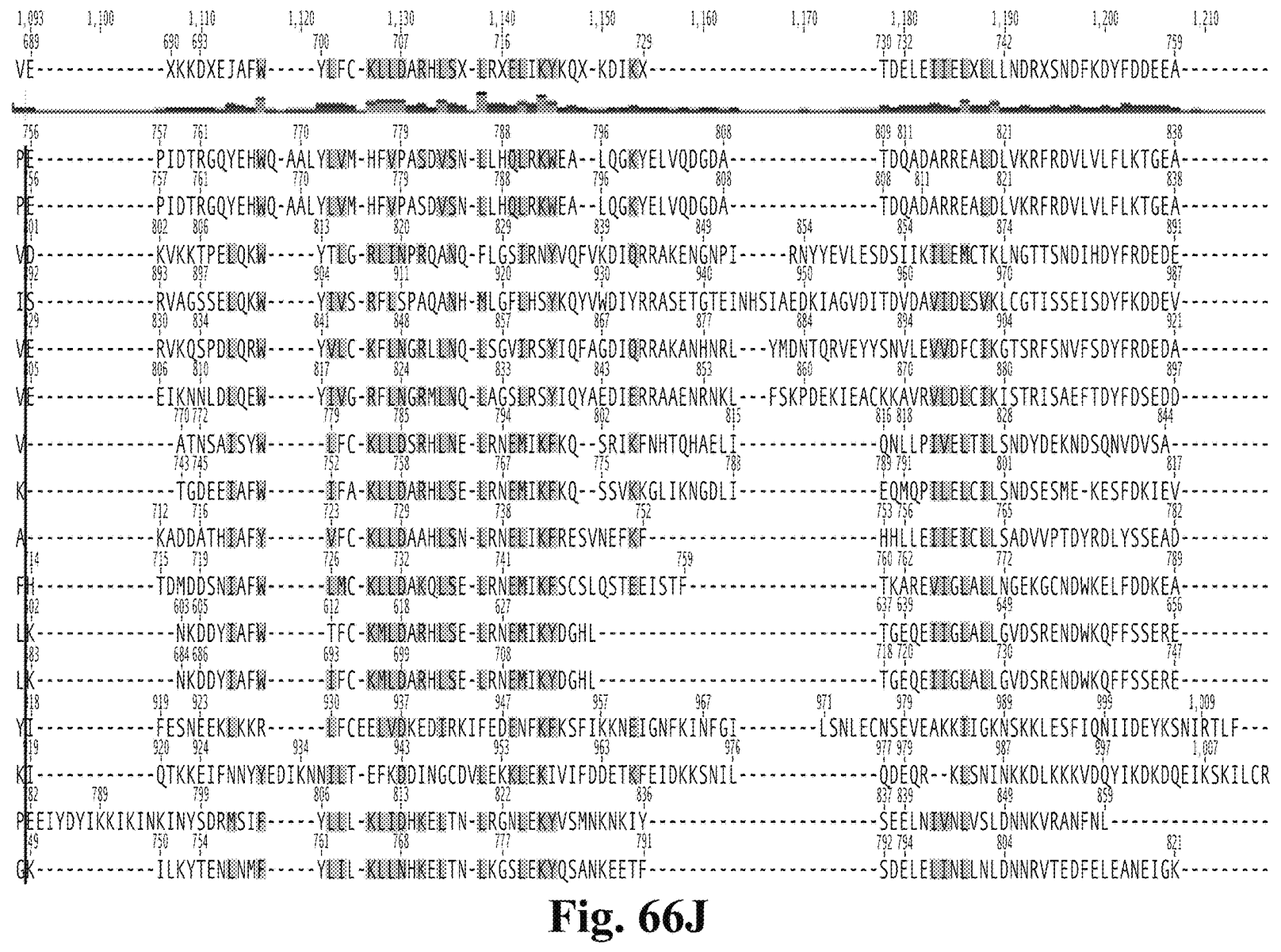
Figure 66K:
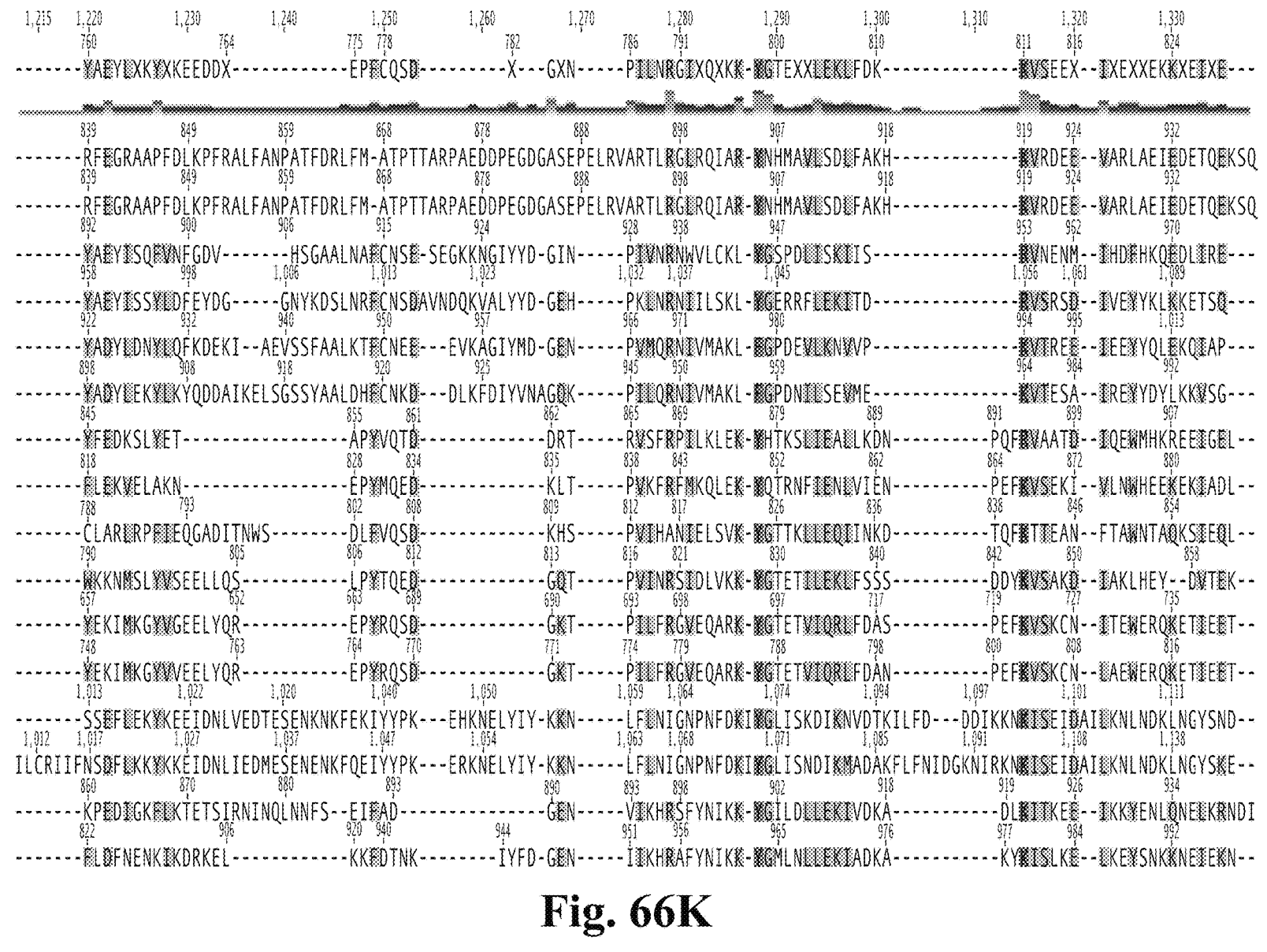
Figure 66L:
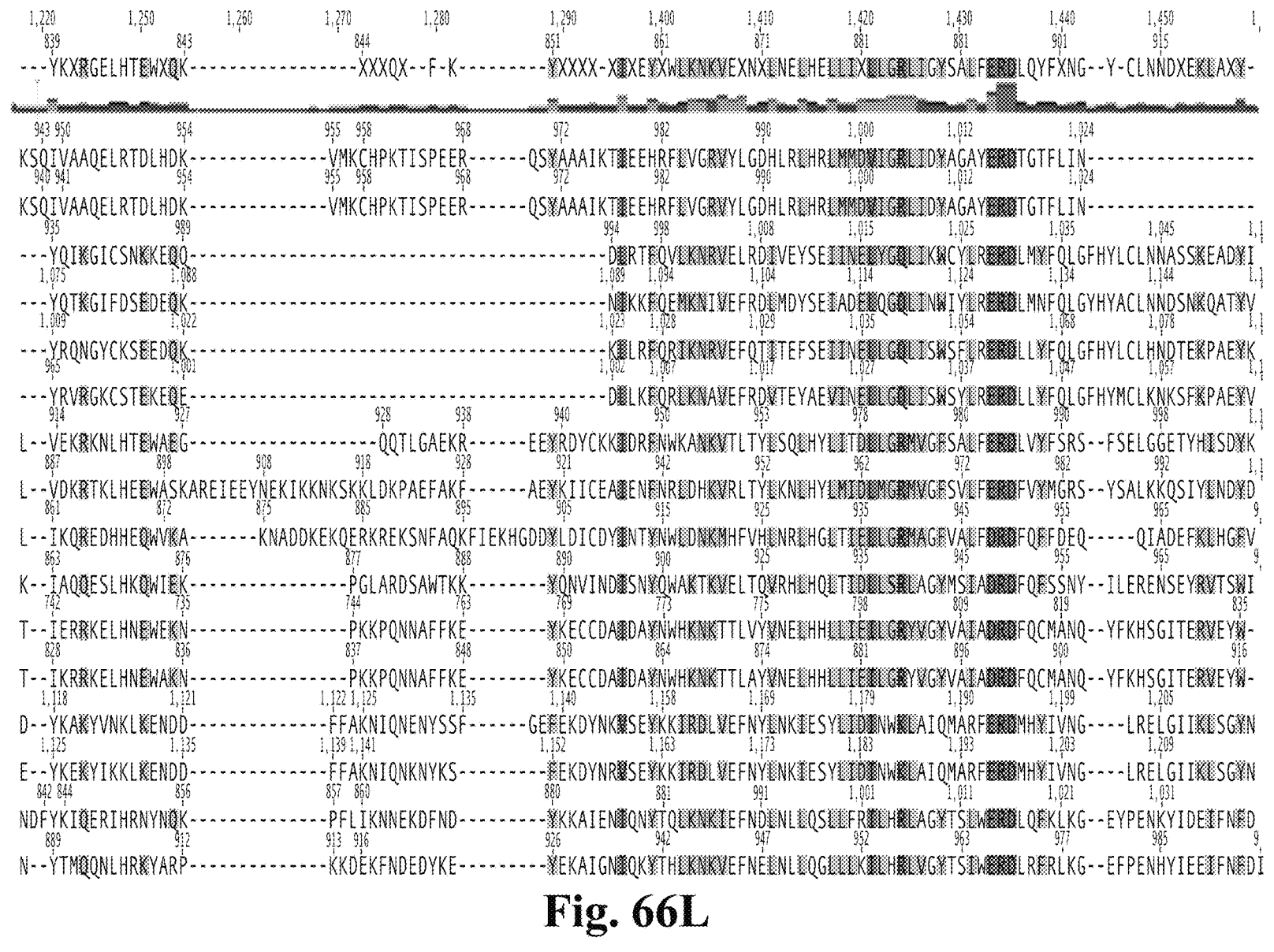
Figure 66M:
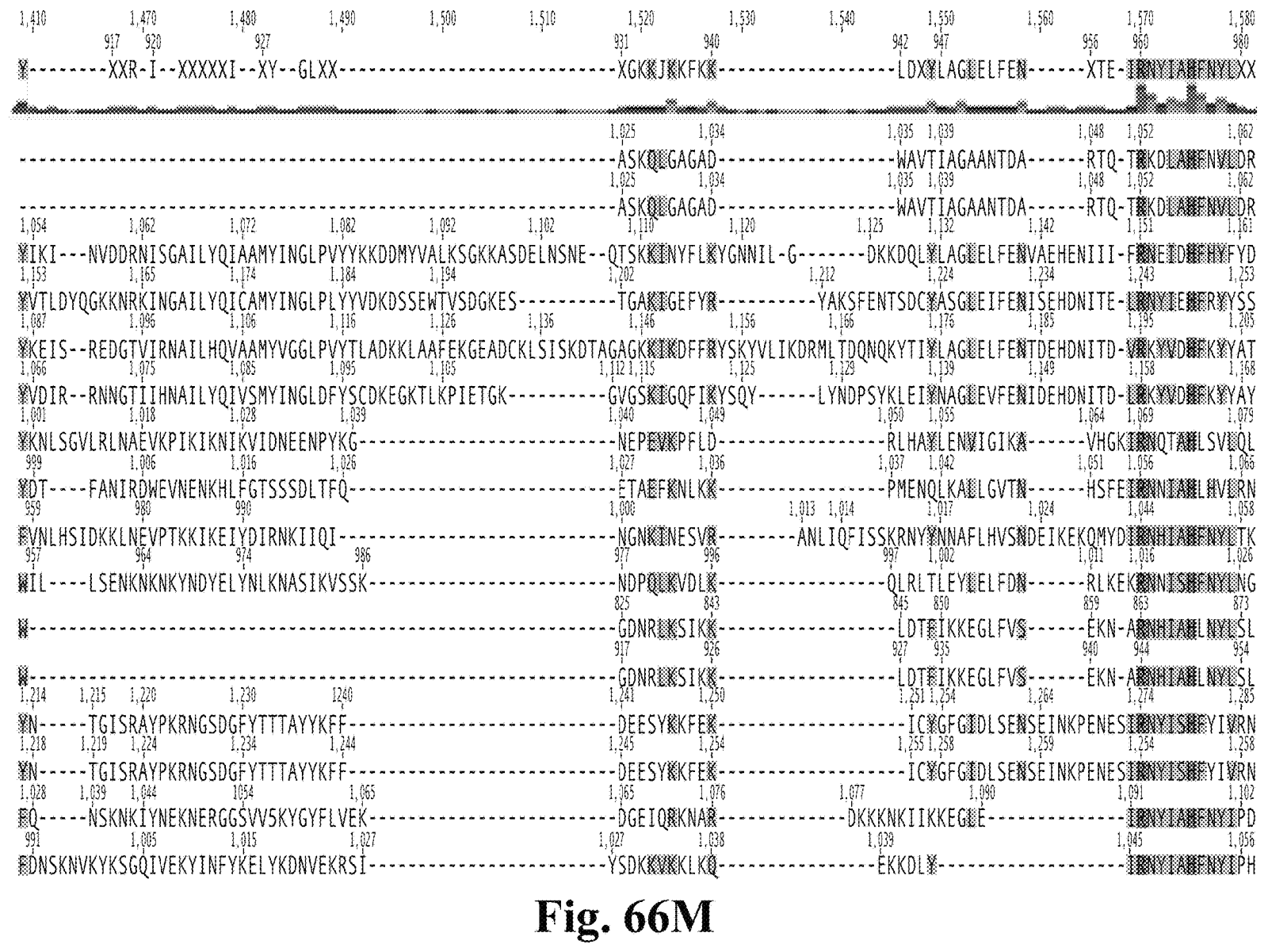
Figure 66N:
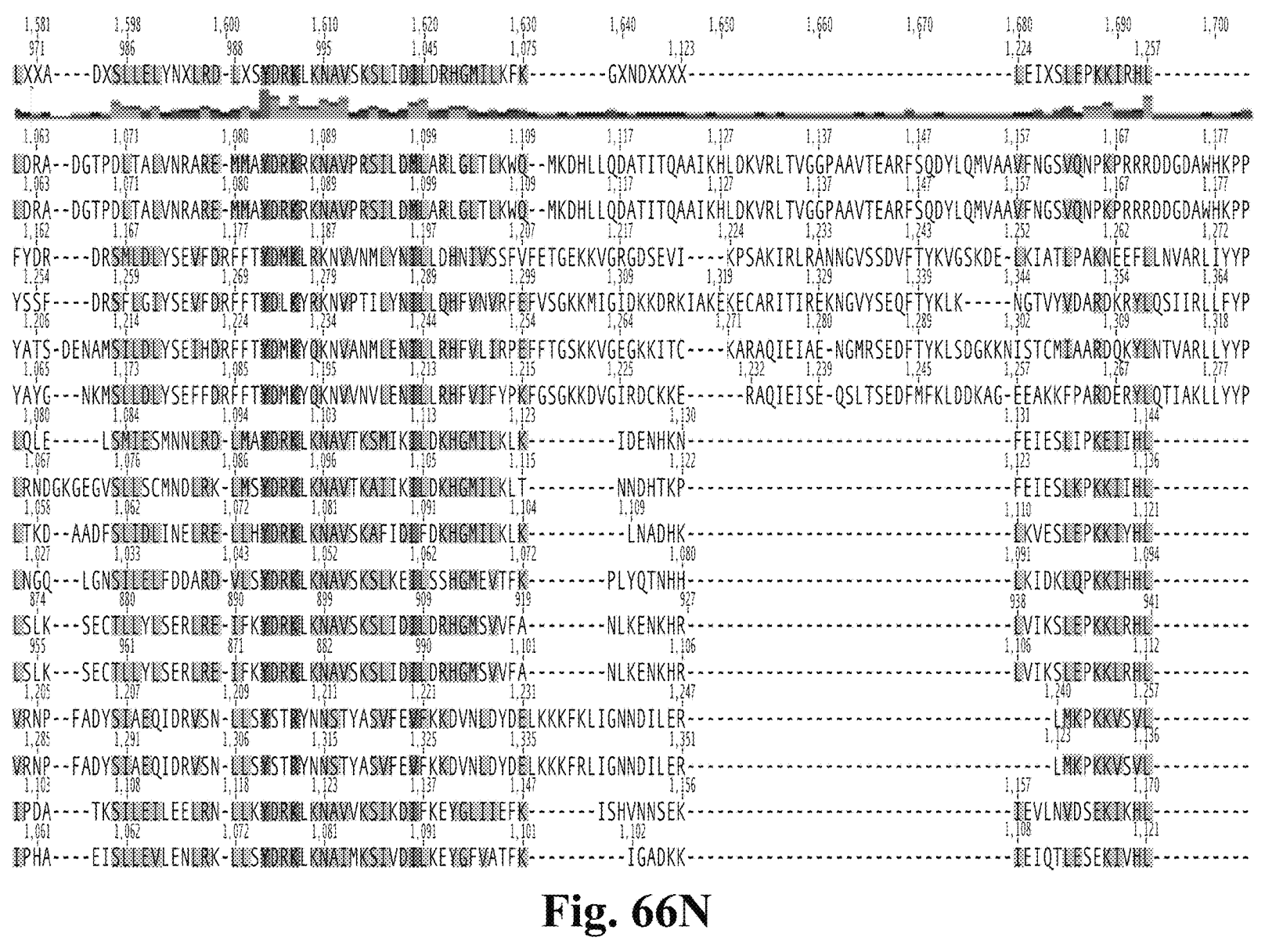
Figure 66O:
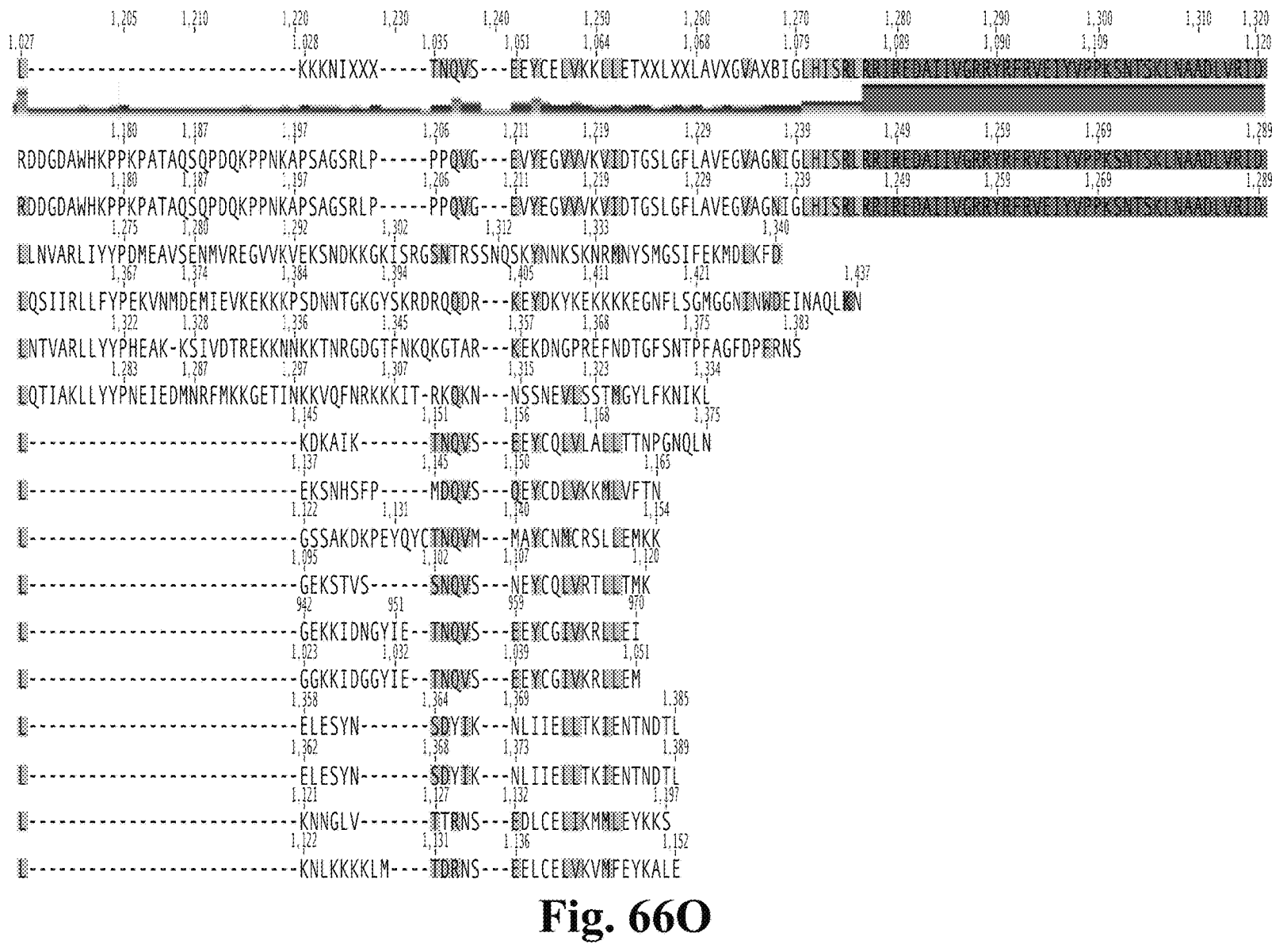

FIG. 66A-66O. Alignment of sequences of different C2C2 orthologs of FIG. 53 (SEQ ID NOS: 68, 69, 59-61, 80, 62-64, 73, 65, 66, 79, 71, 425 and 67, respectively, in order of appearance) with consensus sequence (SEQ ID NO: 180) indicated.

FIG. 67A-67F. Alignment of *Leptotrichia wadei* F0279 C2c2 ("Lew2C2c2") (SEQ ID NO: 67) and *Listeria newyorkensis* FSL M6-0635 C2c2 ("LibC2c2") (SEQ ID NO: 66).

Figure 68:
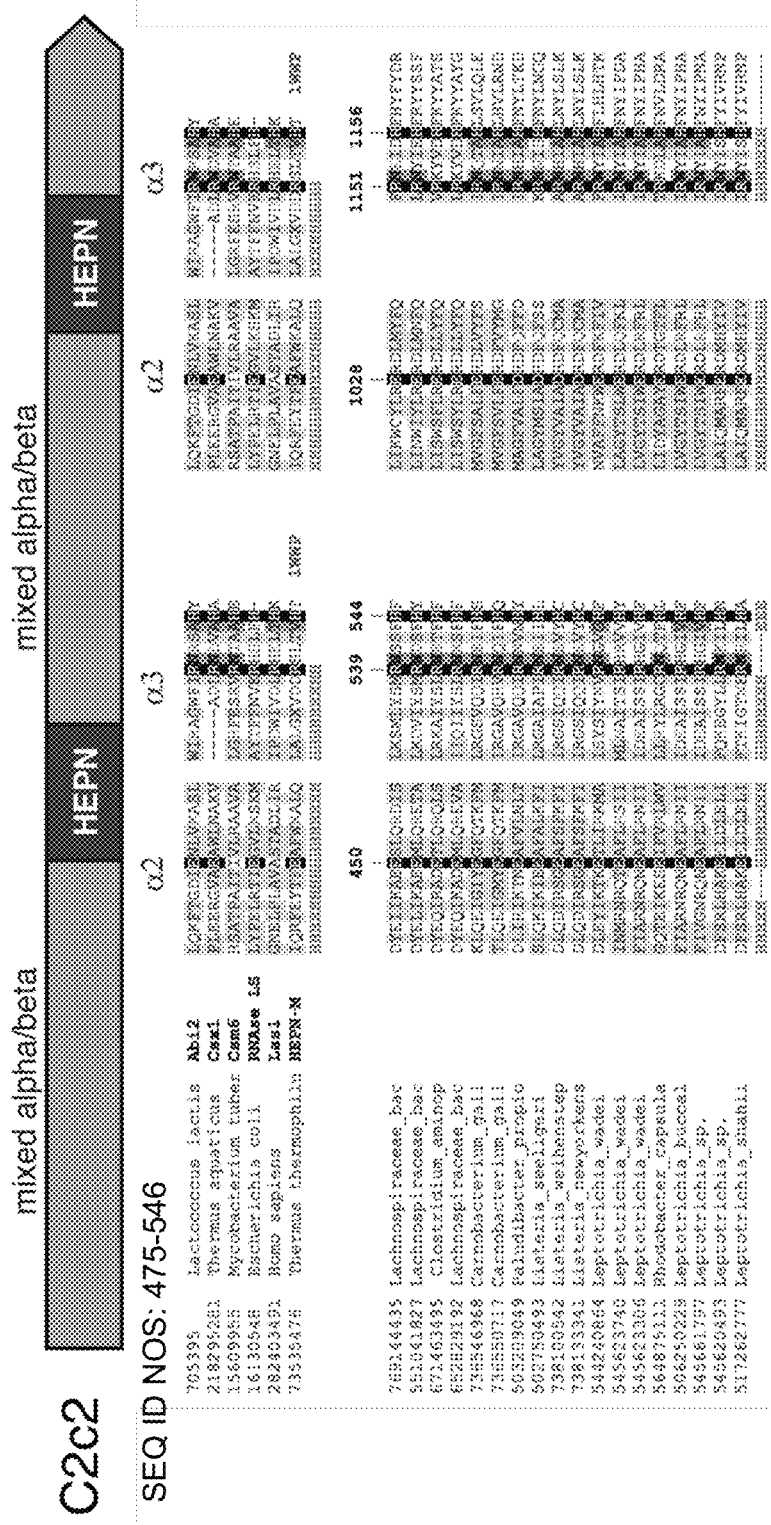

FIG. 68. Alignment of C2c2 HEPN domains, which display RNAse activity. The top alignment blocks include selected HEPN domains (SEQ ID NOS: 451-474, respectively, in order of appearance) described previously and the bottom blocks include the catalytic motifs from the C2c2 effector proteins (SEQ ID NOS: 475-546, respectively, in order of appearance). Underneath each domain architecture, an alignment of the conserved motifs in selected representatives of the respective protein family. The catalytic residues are shown by white letters on a black background; conserved hydrophobic residues are highlighted in yellow; conserved small residues are highlighted in green; in the bridge helix alignment, positively charged residues are in red. Secondary structure prediction is shown underneath the aligned sequences: H denotes a-helix and E denotes extended conformation (β-strand). The poorly conserved spacers between the alignment blocks are shown by numbers.

The figures herein are for illustrative purposes only and are not necessarily drawn to scale.

DETAILED DESCRIPTION OF THE INVENTION

In general, a CRISPR-Cas or CRISPR system as used in the foregoing documents, such as WO 2014/093622 (PCT/US2013/074667) and refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a C2c2 protein, a tracrRNA is not required.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. In some embodiments, a target sequence is located in the nucleus or cytoplasm of a cell. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In general, a guide sequence is any polynucleotide sequence having sufficient complementarity with a target polynucleotide sequence to hybridize with the target sequence and direct sequence-specific binding of a CRISPR complex to the target sequence. The term "targeting sequence" means the portion of a guide sequence having sufficient complementarity with a target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In a classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

The methods according to the invention as described herein comprehend inducing one or more nucleotide modifications in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s) or sgRNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

For minimization of toxicity and off-target effect, it will be important to control the concentration of Cas mRNA or protein and guide RNA delivered. Optimal concentrations of Cas mRNA or protein and guide RNA can be determined by testing different concentrations in a cellular or non-human eukaryote animal model and using deep sequencing to analyze the extent of modification at potential off-target genomic loci.

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets.

The nucleic acid molecule encoding a Cas is advantageously codon optimized Cas. An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a Cas is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.or.jp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way how the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo Biosciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et al. (Cell; 159(2):440-455 (2014)), describing a Cas9 knock-in mouse, which is incorporated herein by reference. The Cas transgene can further comprise a Lox-Stop-polyA-Lox (LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus, such as for instance one or more oncogenic mutations, as for instance and without limitation described in Platt et al. (2014), Chen et al., (2014) or Kumar et al., (2009).

In some embodiments, the Cas sequence is fused to one or more nuclear localization sequences (NLSs) or nuclear export signals (NESs), such as about or more than about 1, 2, 3, 4, 5, 6, 7, 8, 9, 10, or more NLSs or NESs. In some embodiments, the Cas comprises about or more than about 1, 2, 3, 4, 5, 6, 7, 8, 9, 10, or more NLSs or NESs at or near the amino-terminus, about or more than about 1, 2, 3, 4, 5, 6, 7, 8, 9, 10, or more NLSs or NESs at or near the carboxy-terminus, or a combination of these (e.g. zero or at least one or more NLS or NES at the amino-terminus and zero or at one or more NLS or NES at the carboxy terminus). When more than one NLS or NES is present, each may be selected independently of the others, such that a single NLS or NES may be present in more than one copy and/or in combination with one or more other NLSs or NESs present in one or more copies. In a preferred embodiment of the invention, the Cas comprises at most 6 NLSs. In some embodiments, an NLS or NES is considered near the N- or C-terminus when the nearest amino acid of the NLS or NES is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV(SEQ ID NO: 27); the NLS from nucleoplasmin (e.g. the nucleoplasmin bipartite NLS with the sequence KRPAATKKAGQAKKKK) (SEQ ID NO: 28); the c-myc NLS having the amino acid sequence PAAKRVKLD (SEQ ID NO: 29) or RQRRNELKRSP (SEQ ID NO: 30); the hRNPA1 M9 NLS having the sequence NQSSNFGPMKGGNFGGRSSGPYGGGGQYFAK-PRNQGGY(SEQ ID NO: 31); the sequence RMRIZFKNKGKDTAELRRRRVEVSVELRKAKKD-EQILKRRNV (SEQ ID NO: 32) of the IBB domain from importin-alpha; the sequences VSRKRPRP (SEQ ID NO: 33) and PPKKARED (SEQ ID NO: 34) of the myoma T protein; the sequence PQPKKKPL (SEQ ID NO: 35) of human p53; the sequence SALIKKKKKMAP (SEQ ID NO: 36) of mouse c-abl IV; the sequences DRLRR (SEQ ID NO: 37) and PKQKKRK (SEQ ID NO: 38) of the influenza virus NS1; the sequence RKLKKKIKKL (SEQ ID NO: 39) of the Hepatitis virus delta antigen; the sequence REKKKFLKRR (SEQ ID NO: 40) of the mouse Mx1 protein; the sequence KRKGDEVDGVDEVAKKKSKK (SEQ ID NO: 41) of the human poly(ADP-ribose) polymerase; and the sequence RKCLQAGMNLEARKTKK (SEQ ID NO: 42) of the steroid hormone receptors (human) glucocorticoid. Non-limiting examples of NESs include an NES sequence LYPER-LRRILT (SEQ ID NO: 43) (ctgtaccctgagcggctgcggcggatcctgacc (SEQ ID NO: 44)). In general, the one or more NLSs or NESs are of sufficient strength to drive accumulation of the Cas in a detectable amount in respectively the nucleus or the cytoplasm of a eukaryotic cell. In general, strength of nuclear localization/export activity may derive from the number of NLSs/NESs in the Cas, the particular NLS(s) or NES(s) used, or a combination of these factors. Detection of accumulation in the nucleus/cytoplasm may be performed by any suitable technique. For example, a detectable marker may be fused to the Cas, such that location within a cell may be visualized, such as in combination with a means for detecting the location of the nucleus (e.g. a stain specific for the nucleus such as DAPI) or cytoplasm. Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or Cas enzyme activity), as compared to a control no exposed to the Cas or complex, or exposed to a Cas lacking the one or more NLSs or NESs. In certain embodiments, other localization tags may be fused to the Cas protein, such as without limitation for localizing the Cas to particular sites in a cell, such as organelles, such mitochondria, plastids, chloroplast, vesicles, golgi, (nuclear or cellular) membranes, ribosomes, nucleolus, ER, cytoskeleton, vacuoles, centrosome, nucleosome, granules, centrioles, etc.

In certain aspects the invention involves vectors, e.g. for delivering or introducing in a cell Cas and/or RNA capable of guiding Cas to a target locus (i.e. guide RNA), but also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4, 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (http://www.genome-engineering.org/taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner. (see, e.g., http://nar.oxfordjournals.org/content/34/7/e53.short, http://www.nature.com/mt/journal/v16/n9/abs/mt2008144a.html). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters-especially as to the numbers of RNAs or guides discussed herein, without any undue experimentation.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the 3-actin promoter, the phosphoglycerol kinase (PGK) promoter, and the EF1α promoter. An advantageous promoter is the promoter is U6.

Aspects of the invention relate to the identification and engineering of novel effector proteins associated with Class 2 CRISPR-Cas systems. In a preferred embodiment, the effector protein comprises a single-subunit effector module. In a further embodiment the effector protein is functional in prokaryotic or eukaryotic cells for in vitro, in vivo or ex vivo applications. An aspect of the invention encompasses computational methods and algorithms to predict new Class 2 CRISPR-Cas systems and identify the components therein.

In one embodiment, a computational method of identifying novel Class 2 CRISPR-Cas loci comprises the following steps: detecting all contigs encoding the Cas1 protein; identifying all predicted protein coding genes within 20 kB of the cas1 gene, more particularly within the region 20 kb from the start of the cas1 gene and 20 kb from the end of the cas1 gene; comparing the identified genes with Cas protein-specific profiles and predicting CRISPR arrays; selecting partial and/or unclassified candidate CRISPR-Cas loci containing proteins larger than 500 amino acids (>500 aa); analyzing selected candidates using PSI-BLAST and HHpred, thereby isolating and identifying novel Class 2 CRISPR-Cas loci. In addition to the above mentioned steps, additional analysis of the candidates may be conducted by searching metagenomics databases for additional homologs.

In one aspect the detecting all contigs encoding the Cas1 protein is performed by GeneMarkS which a gene prediction program as further described in "GeneMarkS: a self-training method for prediction of gene starts in microbial genomes. Implications for finding sequence motifs in regulatory regions." John Besemer, Alexandre Lomsadze and Mark Borodovsky, Nucleic Acids Research (2001) 29, pp 2607-2618, herein incorporated by reference.

In one aspect the identifying all predicted protein coding genes is carried out by comparing the identified genes with Cas protein-specific profiles and annotating them according to NCBI Conserved Domain Database (CDD) which is a protein annotation resource that consists of a collection of well-annotated multiple sequence alignment models for ancient domains and full-length proteins. These are available as position-specific score matrices (PSSMs) for fast identification of conserved domains in protein sequences via RPS-BLAST. CDD content includes NCBI-curated domains, which use 3D-structure information to explicitly define domain boundaries and provide insights into sequence/structure/function relationships, as well as domain models imported from a number of external source databases (Pfam, SMART, COG, PRK, TIGRFAM). In a further aspect, CRISPR arrays were predicted using a PILER-CR program which is a public domain software for finding CRISPR repeats as described in "PILER-CR: fast and accurate identification of CRISPR repeats", Edgar, R. C., BMC Bioinformatics, January 20; 8:18(2007), herein incorporated by reference.

In a further aspect, the case by case analysis is performed using PSI-BLAST (Position-Specific Iterative Basic Local Alignment Search Tool). PSI-BLAST derives a position-specific scoring matrix (PSSM) or profile from the multiple sequence alignment of sequences detected above a given score threshold using protein-protein BLAST. This PSSM is used to further search the database for new matches, and is updated for subsequent iterations with these newly detected sequences. Thus, PSI-BLAST provides a means of detecting distant relationships between proteins.

In another aspect, the case by case analysis is performed using HHpred, a method for sequence database searching and structure prediction that is as easy to use as BLAST or PSI-BLAST and that is at the same time much more sensitive in finding remote homologs. In fact, HHpred's sensitivity is competitive with the most powerful servers for structure prediction currently available. HHpred is the first server that is based on the pairwise comparison of profile hidden Markov models (HMMs). Whereas most conventional sequence search methods search sequence databases such as UniProt or the NR, HHpred searches alignment databases, like Pfam or SMART. This greatly simplifies the list of hits to a number of sequence families instead of a clutter of single sequences. All major publicly available profile and alignment databases are available through HHpred. HHpred accepts a single query sequence or a multiple alignment as input. Within only a few minutes it returns the search results in an easy-to-read format similar to that of PSI-BLAST. Search options include local or global alignment and scoring secondary structure similarity. HHpred can produce pairwise query-template sequence alignments, merged query-template multiple alignments (e.g. for transitive searches), as well as 3D structural models calculated by the MODELER software from HHpred alignments.

The term "nucleic acid-targeting system", wherein nucleic acid is DNA or RNA, and in some aspects may also refer to DNA-RNA hybrids or derivatives thereof, refers collectively to transcripts and other elements involved in the expression of or directing the activity of DNA or RNA-targeting CRISPR-associated ("Cas") genes, which may include sequences encoding a DNA or RNA-targeting Cas protein and a DNA or RNA-targeting guide RNA comprising a CRISPR RNA (crRNA) sequence and (in some but not all systems) a trans-activating CRISPR/Cas system RNA (tracrRNA) sequence, or other sequences and transcripts from a DNA or RNA-targeting CRISPR locus. In general, a RNA-targeting system is characterized by elements that promote the formation of a DNA or RNA-targeting complex at the site of a target DNA or RNA sequence. In the context of formation of a DNA or RNA-targeting complex, "target sequence" refers to a DNA or RNA sequence to which a DNA or RNA-targeting guide RNA is designed to have complementarity, where hybridization between a target sequence and a RNA-targeting guide RNA promotes the formation of a RNA-targeting complex. In some embodiments, a target sequence is located in the nucleus or cytoplasm of a cell.

In an aspect of the invention, novel RNA targeting systems also referred to as RNA- or RNA-targeting CRISPR/Cas or the CRISPR-Cas system RNA-targeting system of the present application are based on identified Type VI Cas proteins which do not require the generation of customized proteins to target specific RNA sequences but rather a single enzyme can be programmed by a RNA molecule to recognize a specific RNA target, in other words the enzyme can be recruited to a specific RNA target using said RNA molecule.

In an aspect of the invention, novel DNA targeting systems also referred to as DNA- or DNA-targeting CRISPR/Cas or the CRISPR-Cas system RNA-targeting system of the present application are based on identified Type VI Cas proteins which do not require the generation of customized proteins to target specific RNA sequences but rather a single enzyme can be programmed by a RNA molecule to recognize a specific DNA target, in other words the enzyme can be recruited to a specific DNA target using said RNA molecule.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

As used herein, a Cas protein or a CRISPR enzyme refers to any of the proteins presented in the new classification of CRISPR-Cas systems.

C2c2 Nuclease

The Class 2 type VI effector protein C2c2 is a RNA-guided RNase that can be efficiently programmed to degrade ssRNA. C2c2 effector proteins of the invention include, without limitation, the following 21 ortholog species including multiple CRISPR loci: *Leptotrichia shahii*; *Leptotrichia wadei* (Lw2); *Listeria seeligeri*; *Lachnospiraceae bacterium* MA2020; *Lachnospiraceae bacterium* NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; *Listeriaceae bacterium* FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; [*Eubacterium*] *rectale*; *Eubacteriaceae bacterium* CHKCI004; *Blautia* sp. Marseille-P2398; and *Leptotrichia* sp. oral taxon 879 str. F0557. Twelve (12) further non-limiting examples are: *Lachnospiraceae bacterium* NK4A144; *Chloroflexus aggregans*; *Demequina aurantiaca*; *Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae*; *Porphyromonadaceae bacterium* KH3CP3RA; *Listeria riparia*; and *Insolitispirillum peregrinum*.

C2c2 achieves RNA cleavage through conserved basic residues within its two HEPN domains. Mutation of the HEPN domain, such as (e.g. alanine) substitution of predicted HEPN domain catalytic residues can be used to convert C2c2 into an inactive programmable RNA-binding protein (dC2c2, analogous to dCas9).

According to the invention, a consensus sequence can be generated from multiple C2c2 orthologs, which can assist in locating conserved amino acid residues, and motifs, including but not limited to catalytic residues and HEPN motifs in C2c2 orthologs that mediate C2c2 function. One such consensus sequence, generated from the 33 orthologs mentioned above using Geneious alignment is:

(SEQ ID NO: 45)
MKISKVXXXVXKKXXXGKLXKXVNERNRXAKRLSNXLBKYIXXIDKIXKK

EXXKKFXAXEEITLKLNQXXXBXLXKAXXDLRKDNXYSXJKKILHNEDIN

XEEXELLINDXLEKLXKIESXKYSYQKXXXNYXMSVQEHSKKSIXRIXES

AKRNKEALDKFLKEYAXLDPRMEXLAKLRKLLELYFYFKNDXIXXEEEXN

VXXHKXLKENHPDFVEXXXNKENAELNXYAIEXKKJLKYYFPXKXAKNSN

DKIFEKQELKKXWIHQJENAVERILLXXGKVXYKLQXGYLAELWKIRINE

IFIKYIXVGKAVAXFALRNXXKBENDILGGKIXKKLNGITSFXYEKIKAE

EILQREXAVEVAFAANXLYAXDLXXIRXSILQFFGGASNWDXFLFFHFAT

SXISDKKWNAELIXXKKJGLVIREKLYSNNVAMFYSKDDLEKLLNXLXXF

XLRASQVPSFKKVYVRXBFPQNLLKKFNDEKDDEAYSAXYYLLKEIYYNX

FLPYFSANNXFFFXVKNLVLKANKDKFXXAFXDIREMNXGSPIEYLXXTQ

XNXXNEGRKKEEKEXDFIKFLLQIFXKGFDDYLKNNXXFILKFIPEPTEX

IEIXXELQAWYIVGKFLNARKXNLLGXFXSYLKLLDDIELRALRNENIKY

QSSNXEKEVLEXCLELIGLLSLDLNDYFBDEXDFAXYJGKXLDFEKKXMK

DLAELXPYDQNDGENPIVNRNIXLAKKYGTLNLLEKJXDKVSEKEIKEYY

ELKKEIEEYXXKGEELHEEWXQXKNRVEXRDILEYXEELXGQIINYNXLX

NKVLLYFQLGLHYLLLDILGRLVGYTGIWERDAXLYQIAAMYXNGLPEYI

XXKKNDKYKDGQIVGXKINXFKXDKKXLYNAGLELFENXNEHKNIXIRNY

IAHFNYLSKAESSLLXYSENLRXLFSYDRKLKNAVXKSLINILLRHGMVL

KFKFGTDKKSVXIRSXKKIXHLKSIAKKLYYPEVXVSKEYCKLVKXLLKY

K.

HEPN sequence motifs identified from the above orthologs are provided in FIGS. 49 and 50 on the basis of the first 21 orthologs and all 33 orthologs respectively. Non-limiting examples of amino acid residues that can be mutated to generate catalytically dead C2c2 mutants, based on the above consensus include, in or near HEPN1, D372, R377, Q/H382, and F383 or corresponding amino acids of an ortholog, and in or near HEPN2, K893, N894, R898, N899, H903, F904, Y906, Y927, D928, K930, K932 or corresponding amino acids of an ortholog.

In another non-limiting example, a sequence alignment tool to assist generation of a consensus sequence and identification of conserved residues is the MUSCLE alignment tool (www.ebi.ac.uk/Tools/msa/muscle/). For example, using MUSCLE, the following amino acid locations conserved among C2c2 orthologs can be identified in *Leptotrichia wadei* C2c2:K2; K5; V6; E301; L331; I335; N341; G351; K352; E375; L392; L396; D403; F446; I466; I470; R474 (HEPN); H475; H479 (HEPN), E508; P556; L561; I595; Y596; F600; Y669; I673; F681; L685; Y761; L676; L779; Y782; L836; D847; Y863; L869; I872; K879; I933; L954; I958; R961; Y965; E970; R971; D972; R1046 (HEPN), H1051 (HEPN), Y1075; D1076; K1078; K1080; I1083; I1090.

FIG. 52A-K shows an alignment of C2c2 orthologs. FIG. 52L shows an exemplary sequence alignment of HEPN domains and highly conserved residues.

C2c2 HEPN may also target DNA, or potentially DNA and/or RNA. On the basis that the HEPN domains of C2c2 are at least capable of binding to and, in their wild-type form, cutting RNA, then it is preferred that the C2c2 effector protein has RNase function. It may also, or alternatively, have DNase function.

Thus, in some embodiments, the effector protein may be a RNA-binding protein, such as a dead-Cas type effector protein, which may be optionally functionalized as described herein for instance with an transcriptional activator or repressor domain, NLS or other functional domain. In some embodiments, the effector protein may be a RNA-binding protein that cleaves a single strand of RNA. If the RNA bound is ssRNA, then the ssRNA is fully cleaved. In some embodiments, the effector protein may be a RNA-binding protein that cleaves a double strand of RNA, for example if it comprises two RNase domains. If the RNA bound is dsRNA, then the dsRNA is fully cleaved.

RNase function in CRISPR systems is known, for example mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector complex (see, Samai et al., 2015, Cell, vol. 151, 1164-1174). A CRISPR-Cas system, composition or method targeting RNA via the present effector proteins is thus provided.

The target RNA, i.e. the RNA of interest, is the RNA to be targeted by the present invention leading to the recruitment to, and the binding of the effector protein at, the target site of interest on the target RNA. The target RNA may be any suitable form of RNA. This may include, in some embodiments, mRNA. In other embodiments, the target RNA may include tRNA or rRNA. In other embodiments, the target RNA may include miRNA. In other embodiments, the target RNA may include siRNA.

Interfering RNA (RNAi) and microRNA (miRNA)

In other embodiments, the target RNA may include interfering RNA, i.e. RNA involved in an RNA interference pathway, such as shRNA, siRNA and so forth, both in eukaryotes and prokaryotes. In other embodiments, the target RNA may include microRNA (miRNA). Control over interfering RNA or miRNA may help reduce off-target effects (OTE) seen with those approaches by reducing the longevity of the interfering RNA or miRNA in vivo or in vitro.

In certain embodiments, the target is not the miRNA itself, but the miRNA binding site of a miRNA target.

In certain embodiments, miRNAs may be sequestered (such as including subcellularly relocated). In certain embodiments, miRNAs may be cut, such as without limitation at hairpins.

In certain embodiments, miRNA processing (such as including turnover) is increased or decreased.

If the effector protein and suitable guide are selectively expressed (for example spatially or temporally under the control of a suitable promoter, for example a tissue- or cell cycle-specific promoter and/or enhancer) then this could be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The effector protein may be used to control or bind to molecules comprising or consisting of RNA, such as ribozymes, ribosomes or riboswitches. In embodiments of the invention, the RNA guide can recruit the effector protein to these molecules so that the effector protein is able to bind to them.

The protein system of the invention can be applied in areas of RNAi technologies, without undue experimentation, from this disclosure, including therapeutic, assay and other applications (see, e.g., Guidi et al., PLoS Negl Trop Dis 9(5): e0003801. doi:10.1371/journal.pntd; Crotty et al., In vivo RNAi screens: concepts and applications. Shane Crotty . . . 2015 Elsevier Ltd. Published by Elsevier Inc., Pesticide Biochemistry and Physiology (Impact Factor: 2.01). 01/2015; 120. DOI: 10.1016/j.pestbp.2015.01.002 and Makkonen et al., Viruses 2015, 7(4), 2099-2125; doi:10.3390/v7042099), because the present application provides the foundation for informed engineering of the system.

Ribosomal RNA (rRNA)

For example, azalide antibiotics such as azithromycin, are well known. They target and disrupt the 50S ribosomal subunit. The present effector protein, together with a suitable guide RNA to target the 50S ribosomal subunit, may be, in some embodiments, recruited to and bind to the 50S ribosomal subunit. Thus, the present effector protein in concert with a suitable guide directed at a ribosomal (especially the 50S ribosomal subunit) target is provided. Use of this use effector protein in concert with the suitable guide directed at the ribosomal (especially the 50s ribosomal subunit) target may include antibiotic use. In particular, the antibiotic use is analogous to the action of azalide antibiotics, such as azithromycin. In some embodiments, prokaryotic ribosomal subunits, such as the 70S subunit in prokaryotes, the 50S subunit mentioned above, the 30S subunit, as well as the 16S and 5S subunits may be targeted. In other embodiments, eukaryotic ribosomal subunits, such as the 80S subunit in eukaryotes, the 60S subunit, the 40S subunit, as well as the 28S, 18S. 5.8S and 5S subunits may be targeted.

In some embodiments, the effector protein may be a RNA-binding protein, optionally functionalized, as described herein. In some embodiments, the effector protein may be a RNA-binding protein that cleaves a single strand of RNA. In either case, but particularly where the RNA-binding protein cleaves a single strand of RNA, then ribosomal function may be modulated and, in particular, reduced or destroyed. This may apply to any ribosomal RNA and any ribosomal subunit and the sequences of rRNA are well known.

Control of ribosomal activity is thus envisaged through use of the present effector protein in concert with a suitable guide to the ribosomal target. This may be through cleavage of, or binding to, the ribosome. In particular, reduction of ribosomal activity is envisaged. This may be useful in assaying ribosomal function in vivo or in vitro, but also as a means of controlling therapies based on ribosomal activity, in vivo or in vitro. Furthermore, control (i.e. reduction) of protein synthesis in an in vivo or in vitro system is envisaged, such control including antibiotic and research and diagnostic use.

Riboswitches

A riboswitch (also known as an aptazyme) is a regulatory segment of a messenger RNA molecule that binds a small molecule. This typically results in a change in production of the proteins encoded by the mRNA. Thus, control of riboswitch activity is thus envisaged through use of the present effector protein in concert with a suitable guide to the riboswitch target. This may be through cleavage of, or binding to, the riboswitch. In particular, reduction of riboswitch activity is envisaged. This may be useful in assaying riboswitch function in vivo or in vitro, but also as a means of controlling therapies based on riboswitch activity, in vivo or in vitro. Furthermore, control (i.e. reduction) of protein synthesis in an in vivo or in vitro system is envisaged. This control, as for rRNA may include antibiotic and research and diagnostic use.

Ribozymes

Ribozymes are RNA molecules having catalytic properties, analogous to enzymes (which are of course proteins). As ribozymes, both naturally occurring and engineered, comprise or consist of RNA, they may also be targeted by the present RNA-binding effector protein. In some embodiments, the effector protein may be a RNA-binding protein cleaves the ribozyme to thereby disable it. Control of ribozymal activity is thus envisaged through use of the present effector protein in concert with a suitable guide to the ribozymal target. This may be through cleavage of, or binding to, the ribozyme. In particular, reduction of ribozymal activity is envisaged. This may be useful in assaying ribozymal function in vivo or in vitro, but also as a means of controlling therapies based on ribozymal activity, in vivo or in vitro.

Gene Expression, Including RNA Processing

The effector protein may also be used, together with a suitable guide, to target gene expression, including via control of RNA processing. The control of RNA processing may include RNA processing reactions such as RNA splicing, including alternative splicing, via targeting of RNApol; viral replication (in particular of satellite viruses, bacteriophages and retroviruses, such as HBV, HBC and HIV and others listed herein) including viroids in plants; and tRNA biosynthesis. The effector protein and suitable guide may also be used to control RNA activation (RNAa). RNAa leads to the promotion of gene expression, so control of gene expression may be achieved that way through disruption or reduction of RNAa and thus less promotion of gene expression. This is discussed more in detail below.

RNAi Screens

Identifying gene products whose knockdown is associated with phenotypic changes, biological pathways can be interrogated and the constituent parts identified, via RNAi screens. Control may also be exerted over or during these screens by use of the effector protein and suitable guide to remove or reduce the activity of the RNAi in the screen and thus reinstate the activity of the (previously interfered with) gene product (by removing or reducing the interference/repression).

Satellite RNAs (satRNAs) and satellite viruses may also be treated.

Control herein with reference to RNase activity generally means reduction, negative disruption or known-down or knock out.

In Vivo RNA Applications

Inhibition of Gene Expression

The target-specific RNAses provided herein allow for very specific cutting of a target RNA. The interference at RNA level allows for modulation both spatially and temporally and in a non-invasive way, as the genome is not modified.

A number of diseases have been demonstrated to be treatable by mRNA targeting. While most of these studies relate to administration of siRNA, it is clear that the RNA targeting effector proteins provided herein can be applied in a similar way.

Examples of mRNA targets (and corresponding disease treatments) are VEGF, VEGF-R1 and RTP801 (in the treatment of AMD and/or DME), Caspase 2 (in the treatment of Naion) ADRB2 (in the treatment of intraocular pressure), TRPV1 (in the treatment of Dry eye syndrome), Syk kinase (in the treatment of asthma), Apo B (in the treatment of hypercholesterolemia or hypobetalipoproteinemia), PLK1, KSP and VEGF (in the treatment of solid tumors), BCR-ABL (in the treatment of CML) (Burnett and Rossi Chem Biol. 2012, 19(1): 60-71)). Similarly, RNA targeting has been demonstrated to be effective in the treatment of RNA-virus mediated diseases such as HIV (targeting of HIV Tet and Rev), RSV (targeting of RSV nucleocapsid) and HCV (targeting of miR-122) (Burnett and Rossi Chem Biol. 2012, 19(1): 60-71).

It is further envisaged that the RNA targeting effector protein of the invention can be used for mutation specific or allele specific knockdown. Guide RNA's can be designed that specifically target a sequence in the transcribed mRNA comprising a mutation or an allele-specific sequence. Such specific knockdown is particularly suitable for therapeutic applications relating to disorders associated with mutated or allele-specific gene products. For example, most cases of familial hypobetalipoproteinemia (FHBL) are caused by mutations in the ApoB gene. This gene encodes two versions of the apolipoprotein B protein: a short version (ApoB-48) and a longer version (ApoB-100). Several ApoB gene mutations that lead to FHBL cause both versions of ApoB to be abnormally short. Specifically targeting and knockdown of mutated ApoB mRNA transcripts with an RNA targeting effector protein of the invention may be beneficial in treatment of FHBL. As another example, Huntington's disease (HD) is caused by an expansion of CAG triplet repeats in the gene coding for the Huntingtin protein, which results in an abnormal protein. Specifically targeting and knockdown of mutated or allele-specific mRNA transcripts encoding the Huntingtin protein with an RNA targeting effector protein of the invention may be beneficial in treatment of HD.

It is noted that in this context, and more generally for the various applications as described herein, the use of a split version of the RNA targeting effector protein can be envisaged. Indeed, this may not only allow increased specificity but may also be advantageous for delivery. The C2c2 is split in the sense that the two parts of the C2c2 enzyme substantially comprise a functioning C2c2. Ideally, the split should always be so that the catalytic domain(s) are unaffected. That C2c2 may function as a nuclease or it may be a dead-C2c2 which is essentially an RNA-binding protein with very little or no catalytic activity, due to typically mutation(s) in its catalytic domains.

Each half of the split C2c2 may be fused to a dimerization partner. By means of example, and without limitation, employing rapamycin sensitive dimerization domains, allows to generate a chemically inducible split C2c2 for temporal control of C2c2 activity. C2c2 can thus be rendered chemically inducible by being split into two fragments and that rapamycin-sensitive dimerization domains may be used for controlled reassembly of the C2c2. The two parts of the split C2c2 can be thought of as the N' terminal part and the C' terminal part of the split C2c2. The fusion is typically at the split point of the C2c2. In other words, the C' terminal of the N' terminal part of the split C2c2 is fused to one of the dimer halves, whilst the N' terminal of the C' terminal part is fused to the other dimer half.

The C2c2 does not have to be split in the sense that the break is newly created. The split point is typically designed in silico and cloned into the constructs. Together, the two parts of the split C2c2, the N' terminal and C' terminal parts, form a full C2c2, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired C2c2 function is restored or reconstituted. The dimer may be a homodimer or a heterodimer.

In certain embodiments, the C2c2 effector as described herein may be used for mutation-specific, or allele-specific targeting, such as. for mutation-specific, or allele-specific knockdown.

The RNA targeting effector protein can moreover be fused to another functional RNAse domain, such as a non-specific RNase or Argonaute 2, which acts in synergy to increase the RNAse activity or to ensure further degradation of the message.

Modulation of Gene Expression Through Modulation of RNA Function

Apart from a direct effect on gene expression through cleavage of the mRNA, RNA targeting can also be used to impact specific aspects of the RNA processing within the cell, which may allow a more subtle modulation of gene expression. Generally, modulation can for instance be mediated by interfering with binding of proteins to the RNA, such as for instance blocking binding of proteins, or recruiting RNA binding proteins. Indeed, modulations can be ensured at different levels such as splicing, transport, localization, translation and turnover of the mRNA. Similarly in the context of therapy, it can be envisaged to address (pathogenic) malfunctioning at each of these levels by using RNA-specific targeting molecules. In these embodiments it is in many cases preferred that the RNA targeting protein is a "dead" C2c2 that has lost the ability to cut the RNA target but maintains its ability to bind thereto, such as the mutated forms of c2c2 described herein.

A) Alternative Splicing

Many of the human genes express multiple mRNAs as a result of alternative splicing. Different diseases have been shown to be linked to aberrant splicing leading to loss of function or gain of function of the expressed gene. While some of these diseases are caused by mutations that cause splicing defects, a number of these are not. One therapeutic option is to target the splicing mechanism directly. The RNA targeting effector proteins described herein can for instance be used to block or promote slicing, include or exclude exons and influence the expression of specific isoforms and/or stimulate the expression of alternative protein products. Such applications are described in more detail below.

A RNA targeting effector protein binding to a target RNA can sterically block access of splicing factors to the RNA sequence. The RNA targeting effector protein targeted to a splice site may block splicing at the site, optionally redirecting splicing to an adjacent site. For instance a RNA targeting effector protein binding to the 5' splice site binding can block the recruitment of the U1 component of the spliceosome, favoring the skipping of that exon. Alternatively, a RNA targeting effector protein targeted to a splicing enhancer or silencer can prevent binding of transacting regulatory splicing factors at the target site and effectively block or promote splicing. Exon exclusion can further be achieved by recruitment of ILF2/3 to precursor mRNA near an exon by an RNA targeting effector protein as described herein. As yet another example, a glycine rich domain can be attached for recruitment of hnRNP A1 and exon exclusion (Del Gatto-Konczak et al. Mol Cell Biol. 1999 January; 19(1):251-60).

In certain embodiments, through appropriate selection of gRNA, specific splice variants may be targeted, while other splice variants will not be targeted.

In some cases the RNA targeting effector protein can be used to promote slicing (e.g. where splicing is defective). For instance a RNA targeting effector protein can be associated with an effector capable of stabilizing a splicing regulatory stem-loop in order to further splicing. The RNA targeting effector protein can be linked to a consensus binding site sequence for a specific splicing factor in order to recruit the protein to the target DNA.

Examples of diseases which have been associated with aberrant splicing include, but are not limited to Paraneoplastic Opsoclonus Myoclonus Ataxia (or POMA), resulting from a loss of Nova proteins which regulate splicing of proteins that function in the synapse, and Cystic Fibrosis, which is caused by defective splicing of a cystic fibrosis transmembrane conductance regulator, resulting in the production of nonfunctional chloride channels. In other diseases aberrant RNA splicing results in gain-of-function. This is the case for instance in myotonic dystrophy which is caused by a CUG triplet-repeat expansion (from 50 to >1500 repeats) in the 3' UTR of an mRNA, causing splicing defects.

The RNA targeting effector protein can be used to include an exon by recruiting a splicing factor (such as U1) to a 5'splicing site to promote excision of introns around a desired exon. Such recruitment could be mediated trough a fusion with an arginine/serine rich domain, which functions as splicing activator (Gravely B R and Maniatis T, Mol Cell. 1998 (5):765-71).

It is envisaged that the RNA targeting effector protein can be used to block the splicing machinery at a desired locus, resulting in preventing exon recognition and the expression of a different protein product. An example of a disorder that may treated is Duchenne muscular dystrophy (DMD), which is caused by mutations in the gene encoding for the dystrophin protein. Almost all DMD mutations lead to frameshifts, resulting in impaired dystrophin translation. The RNA targeting effector protein can be paired with splice junctions or exonic splicing enhancers (ESEs) thereby preventing exon recognition, resulting in the translation of a partially functional protein. This converts the lethal Duchenne phenotype into the less severe Becker phenotype.

B) RNA Modification

RNA editing is a natural process whereby the diversity of gene products of a given sequence is increased by minor modification in the RNA. Typically, the modification involves the conversion of adenosine (A) to inosine (I), resulting in an RNA sequence which is different from that encoded by the genome. RNA modification is generally ensured by the ADAR enzyme, whereby the pre-RNA target forms an imperfect duplex RNA by base-pairing between the exon that contains the adenosine to be edited and an intronic non-coding element. A classic example of A-I editing is the glutamate receptor GluR-B mRNA, whereby the change results in modified conductance properties of the channel (Higuchi M, et al. Cell. 1993; 75:1361-70).

According to the invention, enzymatic approaches are used to induce transitions (A<→G or C<→U changes) or transversions (any purine to any pyrimidine of vice versa) in the RNA bases of a given transcript. Transitions can be directly induced by using adenine (ADAR1/2), (APOBEC) or cytosine deaminases (AID) which convert A to I or C to U, respectively. Transversions can be indirectly induced by localizing reactive oxygen species damage to the bases of interest, which causes chemical modifications to be added to the affected bases, such as the conversion of guanine to oxo-guanine. An oxo-guanine is recognized as a T and will thus base pair with an adenine causing translation to be affected. Proteins that can be recruited for ROS-mediated base damage include APEX and mini-SOG. With both approaches, these effectors can be fused to a catalytically inactive C2c2 and be recruited to sites on transcripts where these types of mutations are desired.

In humans, a heterozygous functional-null mutation in the ADAR1 gene leads to a skin disease, human pigmentary genodermatosis (Miyamura Y, et al. Am J Hum Genet. 2003; 73:693-9). It is envisaged that the RNA targeting effector proteins of the present invention can be used to correct malfunctioning RNA modification.

It is further envisaged that RNA adenosine methylase (N(6)-methyladenosine) can be fused to the RNA targeting effector proteins of the invention and targeted to a transcript of interest. This methylase causes reversible methylation, has regulatory roles and may affect gene expression and cell fate decisions by modulating multiple RNA-related cellular pathways (Fu et al. Nat Rev Genet. 2014; 15(5):293-306).

C) Polyadenylation

Polyadenylation of an mRNA is important for nuclear transport, translation efficiency and stability of the mRNA, and all of these, as well as the process of polyadenylation, depend on specific RBPs. Most eukaryotic mRNAs receive a 3' poly(A) tail of about 200 nucleotides after transcription. Polyadenylation involves different RNA-binding protein complexes which stimulate the activity of a poly(A)polymerase (Minvielle-Sebastia L et al. Curr Opin Cell Biol. 1999; 11:352-7). It is envisaged that the RNA-targeting effector proteins provided herein can be used to interfere with or promote the interaction between the RNA-binding proteins and RNA.

Examples of diseases which have been linked to defective proteins involved in polyadenylation are oculopharyngeal muscular dystrophy (OPMD) (Brais B, et al. Nat Genet. 1998; 18:164-7).

D) RNA export

After pre-mRNA processing, the mRNA is exported from the nucleus to the cytoplasm. This is ensured by a cellular mechanism which involves the generation of a carrier complex, which is then translocated through the nuclear pore and releases the mRNA in the cytoplasm, with subsequent recycling of the carrier.

Overexpression of proteins (such as TAP) which play a role in the export of RNA has been found to increase export of transcripts that are otherwise inefficiently exported in *Xenopus* (Katahira J, et al. EMBO J. 1999; 18:2593-609).

E) mRNA Localization mRNA localization ensures spatially regulated protein production. Localization of transcripts to a specific region of the cell can be ensured by localization elements. In particular embodiments, it is envisaged that the effector proteins described herein can be used to target localization elements to the RNA of interest. The effector proteins can be designed to bind the target transcript and shuttle them to a location in the cell determined by its peptide signal tag. More particularly for instance, a RNA targeting effector protein fused to one or more nuclear localization signal (NLS) and/or one or more nuclear export signal (NES) can be used to alter RNA localization.

Further examples of localization signals include the zipcode binding protein 1(ZBP1) which ensures localization of 3-actin to the cytoplasm in several asymmetric cell types, KDEL retention sequence (SEQ ID NO: 47) (localization to endoplasmic reticulum), nuclear export signal (localization to cytoplasm), mitochondrial targeting signal (localization to mitochondria), peroxisomal targeting signal (localization to peroxisome) and m6A marking/YTHDF2 (localization to p-bodies). Other approaches that are envisaged are fusion of the RNA targeting effector protein with proteins of known localization (for instance membrane, synapse).

Alternatively, the effector protein according to the invention may for instance be used in localization-dependent knockdown. By fusing the effector protein to a appropriate localization signal, the effector is targeted to a particular cellular compartment. Only target RNAs residing in this compartment will effectively be targeted, whereas otherwise identical targets, but residing in a different cellular compartment will not be targeted, such that a localization dependent knockdown can be established.

F) Translation

The RNA targeting effector proteins described herein can be used to enhance or repress translation. It is envisaged that upregulating translation is a very robust way to control cellular circuits. Further, for functional studies a protein translation screen can be favorable over transcriptional upregulation screens, which have the shortcoming that upregulation of transcript does not translate into increased protein production.

It is envisaged that the RNA targeting effector proteins described herein can be used to bring translation initiation factors, such as EIF4G in the vicinity of the 5' untranslated repeat (5' UTR) of a messenger RNA of interest to drive translation (as described in De Gregorio et al. EMBO J. 1999; 18(17):4865-74 for a non-reprogrammable RNA binding protein). As another example GLD2, a cytoplasmic poly(A) polymerase, can be recruited to the target mRNA by an RNA targeting effector protein. This would allow for directed polyadenylation of the target mRNA thereby stimulating translation.

Similarly, the RNA targeting effector proteins envisaged herein can be used to block translational repressors of mRNA, such as ZBP1 (Huttelmaier S, et al. Nature. 2005; 438:512-5). By binding to translation initiation site of a target RNA, translation can be directly affected.

In addition, fusing the RNA targeting effector proteins to a protein that stabilizes mRNAs, e.g. by preventing degradation thereof such as RNase inhibitors, it is possible to increase protein production from the transcripts of interest.

It is envisaged that the RNA targeting effector proteins described herein can be used to repress translation by binding in the 5'UTR regions of a RNA transcript and preventing the ribosome from forming and beginning translation.

Further, the RNA targeting effector protein can be used to recruit Caf1, a component of the CCR4-NOT deadenylase complex, to the target mRNA, resulting in deadenylation or the target transcript and inhibition of protein translation.

For instance, the RNA targeting effector protein of the invention can be used to increase or decrease translation of therapeutically relevant proteins. Examples of therapeutic applications wherein the RNA targeting effector protein can be used to downregulate or upregulate translation are in amyotrophic lateral sclerosis (ALS) and cardiovascular disorders. Reduced levels of the glial glutamate transporter EAAT2 have been reported in ALS motor cortex and spinal cord, as well as multiple abnormal EAAT2 mRNA transcripts in ALS brain tissue. Loss of the EAAT2 protein and function thought to be the main cause of excitotoxicity in ALS. Restoration of EAAT2 protein levels and function may provide therapeutic benefit. Hence, the RNA targeting effector protein can be beneficially used to upregulate the expression of EAAT2 protein, e.g. by blocking translational repressors or stabilizing mRNA as described above. Apolipoprotein A1 is the major protein component of high density lipoprotein (HDL) and ApoA1 and HDL are generally considered as atheroprotective. It is envisages that the RNA targeting effector protein can be beneficially used to upregulate the expression of ApoA1, e.g. by blocking translational repressors or stabilizing mRNA as described above.

G) mRNA Turnover

Translation is tightly coupled to mRNA turnover and regulated mRNA stability. Specific proteins have been described to be involved in the stability of transcripts (such as the ELAV/Hu proteins in neurons, Keene J D, 1999, Proc Natl Acad Sci USA. 96:5-7) and tristetraprolin (TTP). These proteins stabilize target mRNAs by protecting the messages from degradation in the cytoplasm (Peng S S et al., 1988, EMBO J. 17:3461-70).

It can be envisaged that the RNA-targeting effector proteins of the present invention can be used to interfere with or to promote the activity of proteins acting to stabilize mRNA transcripts, such that mRNA turnover is affected. For instance, recruitment of human TTP to the target RNA using the RNA targeting effector protein would allow for adenylate-uridylate-rich element (AU-rich element) mediated translational repression and target degradation. AU-rich elements are found in the 3' UTR of many mRNAs that code for proto-oncogenes, nuclear transcription factors, and cytokines and promote RNA stability. As another example, the RNA targeting effector protein can be fused to HuR, another mRNA stabilization protein (Hinman M N and Lou H, Cell Mol Life Sci 2008; 65:3168-81), and recruit it to a target transcript to prolong its lifetime or stabilize short-lived mRNA.

It is further envisaged that the RNA-targeting effector proteins described herein can be used to promote degradation of target transcripts. For instance, m6A methyltransferase can be recruited to the target transcript to localize the transcript to P-bodies leading to degradation of the target.

As yet another example, an RNA targeting effector protein as described herein can be fused to the non-specific endonuclease domain PilT N-terminus (PIN), to recruit it to a target transcript and allow degradation thereof.

Patients with paraneoplastic neurological disorder (PND)-associated encephalomyelitis and neuropathy are patients who develop autoantibodies against Hu-proteins in tumors outside of the central nervous system (Szabo A et al. 1991, Cell.; 67:325-33) which then cross the blood-brain barrier. It can be envisaged that the RNA-targeting effector proteins of the present invention can be used to interfere with the binding of auto-antibodies to mRNA transcripts.

Patients with myotonic dystrophy type 1 (DM1), caused by the expansion of (CUG)n in the 3' UTR of dystrophia myotonica-protein kinase (DMPK) gene, are characterized by the accumulation of such transcripts in the nucleus. It is envisaged that the RNA targeting effector proteins of the invention fused with an endonuclease targeted to the (CUG)n repeats could inhibit such accumulation of aberrant transcripts.

H) Interaction with Multi-Functional Proteins

Some RNA-binding proteins bind to multiple sites on numerous RNAs to function in diverse processes. For instance, the hnRNP A1 protein has been found to bind exonic splicing silencer sequences, antagonizing the splicing factors, associate with telomere ends (thereby stimulating telomere activity) and bind miRNA to facilitate Drosha-mediated processing thereby affecting maturation. It is envisaged that the RNA-binding effector proteins of the present invention can interfere with the binding of RNA-binding proteins at one or more locations.

I) RNA Folding

RNA adopts a defined structure in order to perform its biological activities. Transitions in conformation among alternative tertiary structures are critical to most RNA-mediated processes. However, RNA folding can be associated with several problems. For instance, RNA may have a tendency to fold into, and be upheld in, improper alternative conformations and/or the correct tertiary structure may not be sufficiently thermodynamically favored over alternative structures. The RNA targeting effector protein, in particular a cleavage-deficient or dead RNA targeting protein, of the invention may be used to direct folding of (m)RNA and/or capture the correct tertiary structure thereof.

Use of RNA-Targeting Effector Protein in Modulating Cellular Status

In certain embodiments C2c2 in a complex with crRNA is activated upon binding to target RNA and subsequently cleaves any nearby ssRNA targets (i.e. "collateral" or "bystander" effects). C2c2, once primed by the cognate target, can cleave other (non-complementary) RNA molecules. Such promiscuous RNA cleavage could potentially cause cellular toxicity, or otherwise affect cellular physiology or cell status.

Accordingly, in certain embodiments, the non-naturally occurring or engineered composition, vector system, or delivery systems as described herein are used for or are for use in induction of cell dormancy. In certain embodiments, the non-naturally occurring or engineered composition, vector system, or delivery systems as described herein are used for or are for use in induction of cell cycle arrest. In certain embodiments, the non-naturally occurring or engineered composition, vector system, or delivery systems as described herein are used for or are for use in reduction of cell growth and/or cell proliferation. In certain embodiments, the non-naturally occurring or engineered composition, vector system, or delivery systems as described herein are used for or are for use in induction of cell anergy. In certain embodiments, the non-naturally occurring or engineered composition, vector system, or delivery systems as described herein are used for or are for use in induction of cell apoptosis. In certain embodiments, the non-naturally occurring or engineered composition, vector system, or delivery systems as described herein are used for or are for use in induction of cell necrosis. In certain embodiments, the non-naturally occurring or engineered composition, vector system, or delivery systems as described herein are used for or are for use in induction of cell death. In certain embodiments, the non-naturally occurring or engineered composition, vector system, or delivery systems as described herein are used for or are for use in induction of programmed cell death.

In certain embodiments, the invention relates to a method for induction of cell dormancy comprising introducing or inducing the non-naturally occurring or engineered composition, vector system, or delivery systems as described herein. In certain embodiments, the invention relates to a method for induction of cell cycle arrest comprising introducing or inducing the non-naturally occurring or engineered composition, vector system, or delivery systems as described herein. In certain embodiments, the invention relates to a method for reduction of cell growth and/or cell proliferation comprising introducing or inducing the non-naturally occurring or engineered composition, vector system, or delivery systems as described herein. In certain embodiments, the invention relates to a method for induction of cell anergy comprising introducing or inducing the non-naturally occurring or engineered composition, vector system, or delivery systems as described herein. In certain embodiments, the invention relates to a method for induction of cell apoptosis comprising introducing or inducing the non-naturally occurring or engineered composition, vector system, or delivery systems as described herein. In certain embodiments, the invention relates to a method for induction of cell necrosis comprising introducing or inducing the non-naturally occurring or engineered composition, vector system, or delivery systems as described herein. In certain embodiments, the invention relates to a method for induction of cell death comprising introducing or inducing the non-naturally occurring or engineered composition, vector system, or delivery systems as described herein. In certain embodiments, the invention relates to a method for induction of programmed cell death comprising introducing or inducing the non-naturally occurring or engineered composition, vector system, or delivery systems as described herein.

The methods and uses as described herein may be therapeutic or prophylactic and may target particular cells, cell (sub)populations, or cell/tissue types. In particular, the methods and uses as described herein may be therapeutic or prophylactic and may target particular cells, cell (sub)populations, or cell/tissue types expressing one or more target sequences, such as one or more particular target RNA (e.g. ssRNA). Without limitation, target cells may for instance be cancer cells expressing a particular transcript, e.g. neurons of a given class, (immune) cells causing e.g. autoimmunity, or cells infected by a specific (e.g. viral) pathogen, etc.

Accordingly, in certain embodiments, the invention relates to a method for treating a pathological condition characterized by the presence of undesirable cells (host cells), comprising introducing or inducing the non-naturally occurring or engineered composition, vector system, or delivery systems as described herein. In certain embodiments, the invention relates the use of the non-naturally occurring or engineered composition, vector system, or delivery systems as described herein for treating a pathological condition characterized by the presence of undesirable cells (host cells). In certain embodiments, the invention relates the non-naturally occurring or engineered composition, vector system, or delivery systems as described herein for use in treating a pathological condition characterized by the presence of undesirable cells (host cells). It is to be understood that preferably the CRISPR-Cas system targets a target specific for the undesirable cells. In certain embodiments, the invention relates to the use of the non-naturally occurring or engineered composition, vector system, or delivery systems as described herein for treating, preventing, or alleviating cancer. In certain embodiments, the invention relates to the non-naturally occurring or engineered composition, vector system, or delivery systems as described herein for use in treating, preventing, or alleviating cancer. In certain embodiments, the invention relates to a method for treating, preventing, or alleviating cancer comprising introducing or inducing the non-naturally occurring or engineered composition, vector system, or delivery systems as described herein. It is to be understood that preferably the CRISPR-Cas system targets a target specific for the cancer cells. In certain embodiments, the invention relates to the use of the non-naturally occurring or engineered composition, vector system, or delivery systems as described herein for treating, preventing, or alleviating infection of cells by a pathogen. In certain embodiments, the invention relates to the non-naturally occurring or engineered composition, vector system, or delivery systems as described herein for use in treating, preventing, or alleviating infection of cells by a pathogen. In certain embodiments, the invention relates to a method for treating, preventing, or alleviating infection of cells by a pathogen comprising introducing or inducing the non-naturally occurring or engineered composition, vector system, or delivery systems as described herein. It is to be understood that preferably the CRISPR-Cas system targets a target specific for the cells infected by the pathogen (e.g. a pathogen derived target). In certain embodiments, the invention relates to the use of the non-naturally occurring or engineered composition, vector system, or delivery systems as described herein for treating, preventing, or alleviating an autoimmune disorder. In certain embodiments, the invention relates to the non-naturally occurring or engineered composition, vector system, or delivery systems as described herein for use in treating, preventing, or alleviating an autoimmune disorder. In certain embodiments, the invention relates to a method for treating, preventing, or alleviating an autoimmune disorder comprising introducing or inducing the non-naturally occurring or engineered composition, vector system, or delivery systems as described herein. It is to be understood that preferably the CRISPR-Cas system targets a target specific for the cells responsible for the autoimmune disorder (e.g. specific immune cells).

Use of RNA-Targeting Effector Protein in RNA Detection or Protein Detection

It is further envisaged that the RNA targeting effector protein can be used for detection of nucleic acids or proteins in a biological sample. The samples can be cellular or cell-free.

In Northern blot assays. Northern blotting involves the use of electrophoresis to separate RNA samples by size. The RNA targeting effector protein can be used to specifically bind and detect the target RNA sequence.

A RNA targeting effector protein can also be fused to a fluorescent protein (such as GFP) and used to track RNA localization in living cells. More particularly, the RNA targeting effector protein can be inactivated in that it no longer cleaves RNA. In particular embodiments, it is envisaged that a split RNA targeting effector protein can be used, whereby the signal is dependent on the binding of both subproteins, in order to ensure a more precise visualization. Alternatively, a split fluorescent protein can be used that is reconstituted when multiple RNA targeting effector protein complexes bind to the target transcript. It is further envisaged that a transcript is targeted at multiple binding sites along the mRNA so the fluorescent signal can amplify the true signal and allow for focal identification. As yet another alternative, the fluorescent protein can be reconstituted form a split intein.

RNA targeting effector proteins are for instance suitably used to determine the localization of the RNA or specific splice variants, the level of mRNA transcript, up- or down regulation of transcripts and disease-specific diagnosis. The RNA targeting effector proteins can be used for visualization of RNA in (living) cells using e.g. fluorescent microscopy or flow cytometry, such as fluorescence-activated cell sorting (FACS) which allows for high-throughput screening of cells and recovery of living cells following cell sorting. Further, expression levels of different transcripts can be assessed simultaneously under stress, e.g. inhibition of cancer growth using molecular inhibitors or hypoxic conditions on cells. Another application would be to track localization of transcripts to synaptic connections during a neural stimulus using two photon microscopy.

In certain embodiments, the components or complexes according to the invention as described herein can be used in multiplexed error-robust fluorescence in situ hybridization (MERFISH; Chen et al. Science; 2015; 348(6233)), such as for instance with (fluorescently) labeled C2c2 effectors.

In Vitro Apex Labeling

Cellular processes depend on a network of molecular interactions among protein, RNA, and DNA. Accurate detection of protein-DNA and protein-RNA interactions is key to understanding such processes. In vitro proximity labeling technology employs an affinity tag combined with e.g. a photoactivatable probe to label polypeptides and RNAs in the vicinity of a protein or RNA of interest in vitro. After UV irradiation the photoactivatable group reacts with proteins and other molecules that are in close proximity to the tagged molecule, thereby labelling them. Labelled interacting molecules can subsequently be recovered and identified. The RNA targeting effector protein of the invention can for instance be used to target a probe to a selected RNA sequence.

These applications could also be applied in animal models for in vivo imaging of disease relevant applications or difficult-to culture cell types.

The invention provides agents and methods for diagnosing and monitoring health states through non-invasive sampling of cell free RNA, including testing for risk and guiding RNA-targeted therapies, and is useful in setting where rapid administration of therapy is important to treatment outcomes. In one embodiment, the invention provides cancer detection methods and agents for circulating tumor RNA, including for monitoring recurrence and/or development of common drug resistance mutations. In another embodiment, the invention provides detection methods and agents for detection and/or identification of bacterial species directly from blood or serum to monitor, e.g., disease progression and sepsis. In an embodiment of the invention, the C2c2 proteins and derivative are used to distinguish and diagnose common diseases such as rhinovirus or upper respiratory tract infections from more serious infections such as bronchitis.

The invention provides methods and agents for rapid genotyping for emergency pharmacogenomics, including guidance for administration of anticoagulants during myocardial infarction or stroke treatment based on, e.g., VKORC1, CYP2C9, and CYP2C19 genotyping.

The invention provides agents and methods for monitoring food contamination by bacteria at all points along a food production and delivery chain. In another embodiment, the invention provides for quality control and monitoring, e.g. by identification of food sources and determination of purity. In one non-limiting example, the invention may be used to identify or confirm a food sources, such as a species of animal meat and seafood.

In another embodiment, the invention is used in orensic determinations. For example, crime scene samples containing blood or other bodily fluids. In an embodiment of the invention, the invention is used to identify nucleic acid samples from fingerprints.

Use of RNA-Targeting Effector Protein in RNA Origami/In Vitro Assembly Lines—Combinatorics RNA origami refers to nanoscale folded structures for creating two-dimensional or three-dimensional structures using RNA as integrated template. The folded structure is encoded in the RNA and the shape of the resulting RNA is thus determined by the synthesized RNA sequence (Geary, et al. 2014. Science, 345 (6198). pp. 799-804). The RNA origami may act as scaffold for arranging other components, such as proteins, into complexes. The RNA targeting effector protein of the invention can for instance be used to target proteins of interest to the RNA origami using a suitable guide RNA.

Use of RNA-Targeting Effector Protein in RNA Isolation or Purification, Enrichment or Depletion It is further envisages that the RNA targeting effector protein when complexed to RNA can be used to isolate and/or purify the RNA. The RNA targeting effector protein can for instance be fused to an affinity tag that can be used to isolate and/or purify the RNA-RNA targeting effector protein complex. Such applications are for instance useful in the analysis of gene expression profiles in cells. In particular embodiments, it can be envisaged that the RNA targeting effector proteins can be used to target a specific noncoding RNA (ncRNA) thereby blocking its activity, providing a useful functional probe. In certain embodiments, the effector protein as described herein may be used to specifically enrich for a particular RNA (including but not limited to increasing stability, etc.), or alternatively to specifically deplete a particular RNA (such as without limitation for instance particular splice variants, isoforms, etc.).

Interrogation of lincRNA Function and Other Nuclear RNAs

Current RNA knockdown strategies such as siRNA have the disadvantage that they are mostly limited to targeting cytosolic transcripts since the protein machinery is cytosolic. The advantage of a RNA targeting effector protein of the present invention, an exogenous system that is not essential to cell function, is that it can be used in any compartment in the cell. By fusing a NLS signal to the RNA targeting effector protein, it can be guided to the nucleus, allowing nuclear RNAs to be targeted. It is for instance envisaged to probe the function of lincRNAs. Long intergenic non-coding RNAs (lincRNAs) are a vastly underexplored area of research. Most lincRNAs have as of yet unknown functions which could be studies using the RNA targeting effector protein of the invention.

Identification of RNA Binding Proteins

Identifying proteins bound to specific RNAs can be useful for understanding the roles of many RNAs. For instance, many lincRNAs associate with transcriptional and epigenetic regulators to control transcription. Understanding what proteins bind to a given lincRNA can help elucidate the components in a given regulatory pathway. A RNA targeting effector protein of the invention can be designed to recruit a biotin ligase to a specific transcript in order to label locally bound proteins with biotin. The proteins can then be pulled down and analyzed by mass spectrometry to identify them.

Assembly of Complexes on RNA and Substrate Shuttling

RNA targeting effector proteins of the invention can further be used to assemble complexes on RNA. This can be achieved by functionalizing the RNA targeting effector protein with multiple related proteins (e.g. components of a particular synthesis pathway). Alternatively, multiple RNA targeting effector proteins can be functionalized with such different related proteins and targeted to the same or adjacent target RNA. Useful application of assembling complexes on RNA are for instance facilitating substrate shuttling between proteins.

Synthetic Biology

The development of biological systems have a wide utility, including in clinical applications. It is envisaged that the programmable RNA targeting effector proteins of the invention can be used fused to split proteins of toxic domains for targeted cell death, for instance using cancer-linked RNA as target transcript. Further, pathways involving protein-protein interaction can be influenced in synthetic biological systems with e.g. fusion complexes with the appropriate effectors such as kinases or other enzymes.

Protein Splicing: Inteins

Protein splicing is a post-translational process in which an intervening polypeptide, referred to as an intein, catalyzes its own excision from the polypeptides flacking it, referred to as exteins, as well as subsequent ligation of the exteins. The assembly of two or more RNA targeting effector proteins as described herein on a target transcript could be used to direct the release of a split intein (Topilina and Mills Mob DNA. 2014 Feb. 4; 5(1):5), thereby allowing for direct computation of the existence of a mRNA transcript and subsequent release of a protein product, such as a metabolic enzyme or a transcription factor (for downstream actuation of transcription pathways). This application may have significant relevance in synthetic biology (see above) or large-scale bioproduction (only produce product under certain conditions).

Inducible, Dosed and Self-Inactivating Systems

In one embodiment, fusion complexes comprising an RNA targeting effector protein of the invention and an effector component are designed to be inducible, for instance light inducible or chemically inducible. Such inducibility allows for activation of the effector component at a desired moment in time.

Light inducibility is for instance achieved by designing a fusion complex wherein CRY2 PHR/CIBN pairing is used for fusion. This system is particularly useful for light induction of protein interactions in living cells (Konermann S, et al. Nature. 2013; 500:472-476).

Chemical inducibility is for instance provided for by designing a fusion complex wherein FKBP/FRB (FK506 binding protein/FKBP rapamycin binding) pairing is used for fusion. Using this system rapamycin is required for binding of proteins (Zetsche et al. Nat Biotechnol. 2015; 33(2):139-42 describes the use of this system for Cas9).

Further, when introduced in the cell as DNA, the RNA targeting effector protein of the inventions can be modulated by inducible promoters, such as tetracycline or doxycycline controlled transcriptional activation (Tet-On and Tet-Off expression system), hormone inducible gene expression system such as for instance an ecdysone inducible gene expression system and an arabinose-inducible gene expression system. When delivered as RNA, expression of the RNA targeting effector protein can be modulated via a riboswitch, which can sense a small molecule like tetracycline (as described in Goldfless et al. Nucleic Acids Res. 2012; 40(9):e64).

In one embodiment, the delivery of the RNA targeting effector protein of the invention can be modulated to change the amount of protein or crRNA in the cell, thereby changing the magnitude of the desired effect or any undesired off-target effects.

In one embodiment, the RNA targeting effector proteins described herein can be designed to be self-inactivating. When delivered to a cell as RNA, either mRNA or as a replication RNA therapeutic (Wrobleska et al. Nat Biotechnol. 2015 August; 33(8): 839-841), they can self-inactivate expression and subsequent effects by destroying the own RNA, thereby reducing residency and potential undesirable effects.

For further in vivo applications of RNA targeting effector proteins as described herein, reference is made to Mackay J P et al. (Nat Struct Mol Biol. 2011 March; 18(3):256-61), Nelles et al. (Bioessays. 2015 July; 37(7):732-9) and Abil Z and Zhao H (Mol Biosyst. 2015 October; 11(10):2658-65), which are incorporated herein by reference. In particular, the following applications are envisaged in certain embodiments of the invention, preferably in certain embodiments by using catalytically inactive C2c2: enhancing translation (e.g. C2c2-translation promotion factor fusions (e.g. eIF4 fusions)); repressing translation (e.g. gRNA targeting ribosome binding sites); exon skipping (e.g. gRNAs targeting splice donor and/or acceptor sites); exon inclusion (e.g. gRNA targeting a particular exon splice donor and/or acceptor site to be included or C2c2 fused to or recruiting spliceosome components (e.g. U1 snRNA)); accessing RNA localization (e.g. C2c2-marker fusions (e.g., EGFP fusions)); altering RNA localization (e.g. C2c2-localization signal fusions (e.g. NLS or NES fusions)); RNA degradation (in this case no catalytically inactive C2c2 is to be used if relied on the activity of C2c2, alternatively and for increased specificity, a split C2c2 may be used); inhibition of non-coding RNA function (e.g. miRNA), such as by degradation or binding of gRNA to functional sites (possibly titrating out at specific sites by relocalization by C2c2-signal sequence fusions).

As described herein before and demonstrated in the Examples, C2c2 function is robust to 5' or 3' extensions of the crRNA and to extension of the crRNA loop. It is therefore envisages that MS2 loops and other recruitment domains can be added to the crRNA without affecting complex formation and binding to target transcripts. Such modifications to the crRNA for recruitment of various effector domains are applicable in the uses of a RNA targeted effector proteins described above.

As demonstrated in the Examples, C2c2, in particular LshC2c2, is capable of mediating resistance to RNA phages. It is therefore envisaged that C2c2 can be used to immunize, e.g. animals, humans and plants, against RNA-only pathogens, including but not limited to retroviruses (e.g. lentiviruses, such as HIV), HCV, Ebola virus and Zika virus.

The present inventors have shown that C2c2 can processes (cleaves) its own array. This applies to both the wildtype C2c2 protein and the mutated C2c2 protein containing one or more mutated amino acid residues R597, H602, R1278 and H1283, such as one or more of the modifications selected from R597A, H602A, R1278A and H1283A. It is therefore envisaged that multiple crRNAs designed for different target transcripts and/or applications can be delivered as a single pre-crRNA or as a single transcript driven by one promotor. Such method of delivery has the advantages that it is substantially more compact, easier to synthesize and easier to delivery in viral systems. Preferably, amino acid numbering as described herein refers to LshC2c2 protein. It will be understood that exact amino acid positions may vary for orthologues of LshC2c2, which can be adequately determined by protein alignment, as is known in the art, and as described herein elsewhere.

Aspects of the invention also encompass methods and uses of the compositions and systems described herein in genome or transcriptome engineering, e.g. for altering or manipulating the (protein) expression of one or more genes or the one or more gene products, in prokaryotic or eukaryotic cells, in vitro, in vivo or ex vivo.

In an aspect, the invention provides methods and compositions for modulating, e.g., reducing, (protein) expression of a target RNA in cells. In the subject methods, a C2c2 system of the invention is provided that interferes with transcription, stability, and/or translation of an RNA.

In certain embodiments, an effective amount of C2c2 system is used to cleave RNA or otherwise inhibit RNA expression. In this regard, the system has uses similar to siRNA and shRNA, thus can also be substituted for such methods. The method includes, without limitation, use of a C2c2 system as a substitute for e.g., an interfering ribonucleic acid (such as an siRNA or shRNA) or a transcription template thereof, e.g., a DNA encoding an shRNA. The C2c2 system is introduced into a target cell, e.g., by being administered to a mammal that includes the target cell.

Advantageously, a C2c2 system of the invention is specific. For example, whereas interfering ribonucleic acid (such as an siRNA or shRNA) polynucleotide systems are plagued by design and stability issues and off-target binding, a C2c2 system of the invention can be designed with high specificity.

Destabilized C2c2

In certain embodiments, the effector protein (CRISPR enzyme; C2c2) according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT or CMP8 In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the CRISPR enzyme with one or two DDs fused to the C-terminal of the CRISPR enzyme. In some embodiments, the at least two DDs are associated with the CRISPR enzyme and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the CRISPR enzyme and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N- or C-terminus may enhance degradation; and such a tandem fusion can be, for example ER50-ER50-C2c2 or DHFR-DHFR-C2c2. It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the CRISPR enzyme with the DD comprises a linker between the DD and the CRISPR enzyme. In some embodiments, the linker is a Gly-Ser linker. In some embodiments, the DD-CRISPR enzyme further comprises at least one Nuclear Export Signal (NES). In some embodiments, the DD-CRISPR enzyme comprises two or more NESs. In some embodiments, the DD-CRISPR enzyme comprises at least one Nuclear Localization Signal (NLS). This may be in addition to an NES. In some embodiments, the CRISPR enzyme comprises or consists essentially of or consists of a localization (nuclear import or export) signal as, or as part of, the linker between the CRISPR enzyme and the DD. HA or Flag tags are also within the ambit of the invention as linkers. Applicants use NLS and/or NES as linker and also use Glycine Serine linkers as short as GS up to (GGGGS)$_3$ (SEQ ID NO: 46).

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, a temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3β.[6,7] This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a CRISPR enzyme confers to the CRISPR protein degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)[12], it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a CRISPR enzyme and its stability can be regulated or perturbed using a ligand, whereby the CRISPR enzyme has a DD. Another DD can be a 12-kDa (107-amino-acid) tag based on a mutated FKBP protein, stabilized by Shieldi ligand; see, e.g., Nature Methods 5, (2008). For instance a D D can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282:24866-24872; and Rodriguez, Chem Biol. Mar. 23, 2012; 19(3): 391-398-all of which are incorporated herein by reference and may be employed in the practice of the invention in selected a DD to associate with a CRISPR enzyme in the practice of this invention. As can be seen, the knowledge in the art includes a number of DDs, and the DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the CRISPR enzyme and hence the CRISPR-Cas complex or system to be regulated or controlled turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses the system is inducible. In some other senses, the system repressed in the absence of stabilizing ligand and de-repressed in the presence of stabilizing ligand.

Application of RNA Targeting RNA Targeting-CRISPR System to Plants and Yeast

Definitions

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, *eucalyptus*, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, *papaya*, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for modulating gene expression using the RNA targeting RNA targeting system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., *petunia*, rose, *chrysanthemum*), conifers and pine trees (e.g., pine fir, spruce); plants used in phytoremediation (e.g., heavy metal accumulating plants); oil crops (e.g., sunflower, rape seed) and plants used for experimental purposes (e.g. *Arabidopsis*). Thus, the methods and CRISPR-Cas systems can be used over a broad range of plants, such as for example with dicotyledonous plants belonging to the orders Magnoliales, Illiciales, Laurales, Piperales, Aristolochiales, Nymphaeales, Ranunculales, Papaverines, Sarraceniaceae, Trochodendrales, Hamarnelidales, Eucommiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, -Laloragales, Myrtales, Cornales, Proteales, Santalales, Rafflesiales, Celastrales, Euphorbiales, Rhamnales, Sapindales, Juglandales, Geraniales, Polygalales, Unmbellales, Gentianales, Polernoniales, Lamiales, Plantaginales, Scrophulariales, Campanulales, Rubiales, Dipsacales, and Asterales; the methods and CRISPR-Cas systems can be used with rnonocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Liliales and Orchid ales, or with plants belonging to Gymnospermae, e.g those belonging to the orders Pinales, Ginkgoales, Cycadales, Araucariales, Cupressales and Gnetales.

The RNA targeting CRISPR systems and methods of use described herein can be used over a broad range of plant species, included in the non-limitative list of dicot, monocot or gymnosperm genera hereunder: *Atropa, AUseodaphne, Anacardium, Arachis, Beilschmiedia, Brassica, Cartharnus, Cocculus, Croton, Cucunis, Citrus, Citrulus, Capsicum,*

*Catharanthus, Cocos, Coffea, Cucurbita, Daucus, Duguetia, Eschscholzia, Ficus, Fragaria, Glaucium, Glycine, Gossyphm, Helicanthus, Hevea, Hyosvyainus, Lactuca, Landolphia, Linum, Litsea, Lycopersicon, Lupinus, MaJinihot, Majorcina, Mlalus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobromwa, Trifolium, Trigonella, Vicia, Vinca, Vitis*, and *Vigna*; and the genera *Allium, Andropogon, Aragrostis, Asparagus, Avena, Cvnodon, Elaeis, Festuca, Festulolium, Hemerocalhs, Hordeumn, Lemna, Lohim, Musa, Oryza, Panicum, Pennisetum, Phleum, Poa, Secale, Sorghum, Triticum, Zea, Abies, Cunninghamia, Ephedra, Picea, Pinus*, and *Pseudotsuga*.

The RNA targeting CRISPR systems and methods of use can also be used over a broad range of "algae" or "algae cells"; including for example algae selected from several eukaryotic phyla, including the Rhodophyta (red algae), Chlorophyta (green algae), Phaeophyta (brown algae), Bacillariophyta (diatoms), Eustigmatophytes and dinoflagellates as well as the prokaryotic phylum Cyanobacteria (blue-green algae). The term "algae" includes for example algae selected from: *Amphora, Anabaena, Ankistrodesmus, Botryococcus, Chaetoceros, Chlamydomionas, Chlorella, Chlorococcum, Cyclotella, Cylindrotheca, Dunaliella, Emiliania, Euglena, Haematococcus, Isochrysis, Monochrysis, Monoraphidium, Nannochloris, Nannochloropsis, Navicula, Nephrochloris, Nephroselmis, Nitzschia, Nodularia, Nostoc, Ochromonas, Oocystis, Oscillatoria, Pavlova, Phaeodactylum, Platymonas, Pleurochrysis, Porphyra, Pseudoanabaena, Pyramimonas, Stichococcus, Synechococcus, Synechocystis, Tetraselmis, Thalassiosira*, and *Trichodesmium*.

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendants of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerevisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and Issatchenkia spp. (e.g., *Issatchenkia orientalis*, a.k.a. *Pichia* kudriavzevii and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guide RNA may more often be a rate-limiting component in genome engineering of polyploid cells than in haploid cells, and thus the methods using the C2c2 CRISPRs system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2μ plasmids, yeast integrative plasmids, yeast replicative plasmids, shuttle vectors, and episomal plasmids.

Stable Integration of RNA Targeting CRISP System Components in the Genome of Plants and Plant Cells In particular embodiments, it is envisaged that the polynucleotides encoding the components of the RNA targeting CRISPR system are introduced for stable integration into the genome of a plant cell. In these embodiments, the design of the transformation vector or the expression system can be adjusted depending on when, where and under what conditions the guide RNA and/or the RNA targeting gene(s) are expressed.

In particular embodiments, it is envisaged to introduce the components of the RNA targeting CRISPR system stably into the genomic DNA of a plant cell. Additionally or alternatively, it is envisaged to introduce the components of the RNA targeting CRISPR system for stable integration into the DNA of a plant organelle such as, but not limited to a plastid, a mitochondrion or a chloroplast.

The expression system for stable integration into the genome of a plant cell may contain one or more of the following elements: a promoter element that can be used to express the guide RNA and/or RNA targeting enzyme in a plant cell; a 5' untranslated region to enhance expression; an intron element to further enhance expression in certain cells, such as monocot cells; a multiple-cloning site to provide convenient restriction sites for inserting the one or more guide RNAs and/or the RNA targeting gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a RNA targeting CRISPR expression system comprises at least:
(a) a nucleotide sequence encoding a guide RNA (gRNA) that hybridizes with a target sequence in a plant, and wherein the guide RNA comprises a guide sequence and a direct repeat sequence, and
(b) a nucleotide sequence encoding a RNA targeting protein, wherein components (a) or (b) are located on the same or on different constructs, and whereby the different nucleotide sequences can be under control of the same or a different regulatory element operable in a plant cell.

DNA construct(s) containing the components of the RNA targeting CRISPR system, and, where applicable, template sequence may be introduced into the genome of a plant, plant part., or plant cell by a variety of conventional techniques. The process generally comprises the steps of selecting a suitable host cell or host tissue, introducing the construct(s) into the host cell or host tissue, and regenerating plant cells or plants therefrom. In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome. (see e.g. Klein et al., Nature (1987), Klein et al., Bio/Technology (1992), Casas et al., Proc. Natl. Acad. Sci. USA (1993)).

In particular embodiments, the DNA constructs containing components of the RNA targeting CRISPR system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the C2c2 CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. The present invention envisages methods for modifying RNA sequences and as such also envisages regulating expression of plant biomolecules. In particular embodiments of the present invention it is thus advantageous to place one or more elements of the RNA targeting CRISPR system under the control of a promoter that can be regulated. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the RNA targeting CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the RNA targeting CRISPR system—are found in Kawamata et al., (1997) Plant Cell Physiol 38:792-803; Yamamoto et al., (1997) Plant J 12:255-65; Hire et al., (1992) Plant Mol Biol 20:207-18, Kuster et al., (1995) Plant Mol Biol 29:759-72, and Capana et al., (1994) Plant Mol Biol 25:681-91.

Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc.), or light inducible systems (Phytochrome, LOV domains, or cryptochrome)., such as a Light Inducible Transcriptional Effector (LITE) that direct changes in transcriptional activity in a sequence-specific manner. The components of a light inducible system may include a RNA targeting CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-ll-27, WO93/01294), activated by hydrophobic electrophilic compounds used as pre-emergent herbicides, and the tobacco PR-1a promoter (Ono et at, (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227:229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the RNA targeting CRISPR system is used to specifically modify expression and/or translation of chloroplast genes or to ensure expression in the chloroplast. For this purpose use is made of chloroplast transformation methods or compartmentalization of the RNA targeting CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the RNA targeting CRISPR components to the plant chloroplast. This is achieved by incorporating in the expression construct a sequence encoding a chloroplast transit peptide (CTP) or plastid transit peptide, operably linked to the 5' region of the sequence encoding the RNA targeting protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the one or more guide RNAs to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the RNA targeting-guide RNA(s).

Introduction of Polynucleotides Encoding the CRISPR-RNA Targeting System in Algal Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species using Cas9. Using similar tools, the methods of the RNA targeting CRISPR system described herein can be applied on *Chlamydomonas* species and other algae. In particular embodiments, RNA targeting protein and guide RNA(s) are introduced in algae expressed using a vector that expresses RNA targeting protein under the control of a constitutive promoter such as Hsp70A-Rbc S2 or Beta2-tubulin. Guide RNA is optionally delivered using a vector containing T7 promoter. Alternatively, RNA targeting mRNA and in vitro transcribed guide RNA can be delivered to algal cells. Electroporation protocols are available to the skilled person such as the standard recommended protocol from the GeneArt *Chlamydomonas* Engineering kit.

Introduction of Polynucleotides Encoding RNA Targeting Components in Yeast Cells In particular embodiments, the invention relates to the use of the RNA targeting CRISPR system for RNA editing in yeast cells. Methods for transforming yeast cells which can be used to introduce polynucleotides encoding the RNA targeting CRISPR system components are well known to the artisan and are reviewed by Kawai et al., 2010, Bioeng Bugs. 2010 November-December; 1(6): 395-403. Non-limiting examples include transformation of yeast cells by lithium acetate treatment (which may further include carrier DNA and PEG treatment), bombardment or by electroporation.

Transient Expression of RNA Targeting CRISP System Components in Plants and Plant Cell In particular embodiments, it is envisaged that the guide RNA and/or RNA targeting gene are transiently expressed in the plant cell. In these embodiments, the RNA targeting CRISPR system can ensure modification of RNA target molecules only when both the guide RNA and the RNA targeting protein is present in a cell, such that gene expression can further be controlled. As the expression of the RNA targeting enzyme is transient, plants regenerated from such plant cells typically contain no foreign DNA. In particular embodiments the RNA targeting enzyme is stably expressed by the plant cell and the guide sequence is transiently expressed.

In particularly preferred embodiments, the RNA targeting CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors, which is of interest in the context of avoiding the production of GMO plants.

In particular embodiments, the vector used for transient expression of RNA targeting CRISPR constructs is for instance a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaLCuV) vector to express gRNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the RNA targeting gene can be transiently introduced into the plant cell. In such embodiments, the introduced double-stranded DNA fragments are provided in sufficient quantity to modify RNA molecule(s) in the cell but do not persist after a contemplated period of time has passed or after one or more cell divisions. Methods for direct DNA transfer in plants are known by the skilled artisan (see for instance Davey et al. Plant Mol Biol. 1989 September; 13(3):273-85.)

In other embodiments, an RNA polynucleotide encoding the RNA targeting protein is introduced into the plant cell, which is then translated and processed by the host cell generating the protein in sufficient quantity to modify the RNA molecule(s) cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122). Combinations of the different methods described above are also envisaged.

Delivery of RNA Targeting CRISPR Components to the Plant Cell

In particular embodiments, it is of interest to deliver one or more components of the RNA targeting CRISPR system directly to the plant cell. This is of interest, inter alia, for the generation of non-transgenic plants (see below). In particular embodiments, one or more of the RNA targeting components is prepared outside the plant or plant cell and delivered to the cell. For instance in particular embodiments, the RNA targeting protein is prepared in vitro prior to introduction to the plant cell. RNA targeting protein can be prepared by various methods known by one of skill in the art and include recombinant production. After expression, the RNA targeting protein is isolated, refolded if needed, purified and optionally treated to remove any purification tags, such as a His-tag. Once crude, partially purified, or more completely purified RNA targeting protein is obtained, the protein may be introduced to the plant cell.

In particular embodiments, the RNA targeting protein is mixed with guide RNA targeting the RNA of interest to form a pre-assembled ribonucleoprotein.

The individual components or pre-assembled ribonucleoprotein can be introduced into the plant cell via electroporation, by bombardment with RNA targeting-associated gene product coated particles, by chemical transfection or by some other means of transport across a cell membrane. For instance, transfection of a plant protoplast with a preassembled CRISPR ribonucleoprotein has been demonstrated to ensure targeted modification of the plant genome (as described by Woo et al. *Nature Biotechnology*, 2015; DOI: 10.1038/nbt.3389). These methods can be modified to achieve targeted modification of RNA molecules in the plants.

In particular embodiments, the RNA targeting CRISPR system components are introduced into the plant cells using nanoparticles. The components, either as protein or nucleic acid or in a combination thereof, can be uploaded onto or packaged in nanoparticles and applied to the plants (such as for instance described in WO 2008042156 and US 20130185823). In particular, embodiments of the invention comprise nanoparticles uploaded with or packed with DNA molecule(s) encoding the RNA targeting protein, DNA molecules encoding the guide RNA and/or isolated guide RNA as described in WO2015089419.

Further means of introducing one or more components of the RNA targeting CRISPR system to the plant cell is by using cell penetrating peptides (CPP). Accordingly, in particular, embodiments the invention comprises compositions comprising a cell penetrating peptide linked to an RNA targeting protein. In particular embodiments of the present invention, an RNA targeting protein and/or guide RNA(s) is coupled to one or more CPPs to effectively transport them inside plant protoplasts (Ramakrishna, Genome Res. 2014

June; 24(6):1020-7 for Cas9 in human cells). In other embodiments, the RNA targeting gene and/or guide RNA(s) are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipathic peptides, peptides having proline-rich and antimicrobial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biomolecule with the target. Examples of CPP include amongst others: Tat, a nuclear transcriptional activator protein required for viral replication by HIV type1, penetratin, Kaposi fibroblast growth factor (FGF) signal peptide sequence, integrin 33 signal peptide sequence; polyarginine peptide sequence, Guanine rich-molecular transporters, sweet arrow peptide, etc.

Target RNA Envisaged for Plant, Algae or Fungal Applications

The target RNA, i.e. the RNA of interest, is the RNA to be targeted by the present invention leading to the recruitment to, and the binding of the RNA targeting protein at, the target site of interest on the target RNA. The target RNA may be any suitable form of RNA. This may include, in some embodiments, mRNA. In other embodiments, the target RNA may include transfer RNA (tRNA) or ribosomal RNA (rRNA). In other embodiments the target RNA may include interfering RNA (RNAi), microRNA (miRNA), microswitches, microzymes, satellite RNAs and RNA viruses. The target RNA may be located in the cytoplasm of the plant cell, or in the cell nucleus or in a plant cell organelle such as a mitochondrion, chloroplast or plastid.

In particular embodiments, the RNA targeting CRISPR system is used to cleave RNA or otherwise inhibit RNA expression.

Use of RNA Targeting CRISPR System for Modulating Plant Gene Expression Via RNA Modulation The RNA targeting protein may also be used, together with a suitable guide RNA, to target gene expression, via control of RNA processing. The control of RNA processing may include RNA processing reactions such as RNA splicing, including alternative splicing or specifically targeting certain splice variants or isoforms; viral replication, in particular of plant viruses, including viroids in plants and tRNA biosynthesis. The RNA targeting protein in combination with a suitable guide RNA may also be used to control RNA activation (RNAa). RNAa leads to the promotion of gene expression, so control of gene expression may be achieved that way through disruption or reduction of RNAa and thus less promotion of gene expression.

The RNA targeting effector protein of the invention can further be used for antiviral activity in plants, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. Provided is therefore the use of an RNA targeting effector protein of the invention as an antiviral agent. Examples of viruses that can be counteracted in this way include, but are not limited to, Tobacco mosaic virus (TMV), Tomato spotted wilt virus (TSWV), Cucumber mosaic virus (CMV), Potato virus Y (PVY), Cauliflower mosaic virus (CaMV) (RT virus), Plum pox virus (PPV), Brome mosaic virus (BMV) and Potato virus X (PVX).

Examples of modulating RNA expression in plants, algae or fungi, as an alternative of targeted gene modification are described herein further.

Of particular interest is the regulated control of gene expression through regulated cleavage of mRNA. This can be achieved by placing elements of the RNA targeting under the control of regulated promoters as described herein.

Use of the RNA Targeting CRISPR System to Restore the Functionality of tRNA Molecules.

Pring et al. describe RNA editing in plant mitochondria and chloroplasts that alters mRNA sequences to code for different proteins than the DNA. (Plant Mol. Biol. (1993) 21 (6): 1163-1170. doi:10.1007/BF00023611). In particular embodiments of the invention, the elements of the RNA targeting CRISPR system specifically targeting mitochondrial and chloroplast mRNA can be introduced in a plant or plant cell to express different proteins in such plant cell organelles mimicking the processes occurring in vivo.

Use of the RNA Targeting CRISPR System as an Alternative to RNA Interference to Inhibit RNA Expression.

The RNA targeting CRISPR system has uses similar to RNA inhibition or RNA interference, thus can also be substituted for such methods. In particular embodiment, the methods of the present invention include the use of the RNA targeting CRISPR as a substitute for e.g. an interfering ribonucleic acid (such as an siRNA or shRNA or a dsRNA). Examples of inhibition of RNA expression in plants, algae or fungi as an alternative of targeted gene modification are described herein further.

Use of the RNA Targeting CRISPR System to Control RNA Interference.

Control over interfering RNA or miRNA may help reduce off-target effects (OTE) seen with those approaches by reducing the longevity of the interfering RNA or miRNA in vivo or in vitro. In particular embodiments, the target RNA may include interfering RNA, i.e. RNA involved in an RNA interference pathway, such as shRNA, siRNA and so forth. In other embodiments, the target RNA may include microRNA (miRNA) or double stranded RNA (dsRNA).

In other particular embodiments, if the RNA targeting protein and suitable guide RNA(s) are selectively expressed (for example spatially or temporally under the control of a regulated promoter, for example a tissue- or cell cycle-specific promoter and/or enhancer) this can be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The RNA targeting protein may be used to control or bind to molecules comprising or consisting of RNA, such as ribozymes, ribosomes or riboswitches. In embodiments of the invention, the guide RNA can recruit the RNA targeting protein to these molecules so that the RNA targeting protein is able to bind to them.

The RNA targeting CRISPR system of the invention can be applied in areas of in-planta RNAi technologies, without undue experimentation, from this disclosure, including insect pest management, plant disease management and management of herbicide resistance, as well as in plant assay and for other applications (see, for instance Kim et al., in Pesticide Biochemistry and Physiology (Impact Factor:

2.01). 01/2015; 120. DOI: 10.1016/j.pestbp.2015.01.002; Sharma et al. in Academic Journals (2015), Vol. 12(18) pp. 2303-2312); Green J. M, in Pest Management Science, Vol 70(9), pp 1351-1357), because the present application provides the foundation for informed engineering of the system.

Use of RNA Targeting CRISPR System to Modify Riboswitches and Control Metabolic Regulation in Plants, Algae and Fungi Riboswitches (also known as aptazymes) are regulatory segments of messenger RNA that bind small molecules and in turn regulate gene expression. This mechanism allows the cell to sense the intracellular concentration of these small molecules. A particular riboswitch typically regulates its adjacent gene by altering the transcription, the translation or the splicing of this gene. Thus, in particular embodiments of the present invention, control of riboswitch activity is envisaged through the use of the RNA targeting protein in combination with a suitable guide RNA to target the riboswitch. This may be through cleavage of, or binding to, the riboswitch. In particular embodiments, reduction of riboswitch activity is envisaged. Recently, a riboswitch that binds thiamine pyrophosphate (TPP) was characterized and found to regulate thiamine biosynthesis in plants and algae. Furthermore it appears that this element is an essential regulator of primary metabolism in plants (Bocobza and Aharoni, Plant J. 2014 August; 79(4):693-703. doi: 10.1111/tpj.12540. Epub 2014 Jun. 17). TPP riboswitches are also found in certain fungi, such as in *Neurospora crassa*, where it controls alternative splicing to conditionally produce an Upstream Open Reading Frame (uORF), thereby affecting the expression of downstream genes (Cheah M T et al., (2007) Nature 447 (7143): 497-500. doi:10.1038/nature05769) The RNA targeting CRISPR system described herein may be used to manipulate the endogenous riboswitch activity in plants, algae or fungi and as such alter the expression of downstream genes controlled by it. In particular embodiments, the RNA targeting CRISP system may be used in assaying riboswitch function in vivo or in vitro and in studying its relevance for the metabolic network. In particular embodiments the RNA targeting CRISPR system may potentially be used for engineering of riboswitches as metabolite sensors in plants and platforms for gene control.

Use of RNA Targeting CRISPR System in RNAi Screens for Plants, Algae or Fungi

Identifying gene products whose knockdown is associated with phenotypic changes, biological pathways can be interrogated and the constituent parts identified, via RNAi screens. In particular embodiments of the invention, control may also be exerted over or during these screens by use of the Guide 29 or Guide 30 protein and suitable guide RNA described herein to remove or reduce the activity of the RNAi in the screen and thus reinstate the activity of the (previously interfered with) gene product (by removing or reducing the interference/repression).

Use of RNA Targeting Proteins for Visualization of RNA Molecules In Vivo and In Vitro In particular embodiments, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. As such, labelled elements of the RNA targeting system can be used as an alternative for efficient and adaptable system for in situ hybridization.

Further Applications of the RNA Targeting CRISPR System in Plants and Yeasts

Use of RNA Targeting CRISPR System in Biofuel Production

The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the RNA targeting CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488).

Modifying Yeast for Biofuel Production

In particular embodiments, the RNA targeting enzyme provided herein is used for bioethanol production by recombinant micro-organisms. For instance, RNA targeting enzymes can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the RNA targeting CRISPR complex is used to modify the expression of endogenous genes required for biofuel production and/or to modify endogenous genes why may interfere with the biofuel synthesis. More particularly the methods involve stimulating the expression in a micro-organism such as a yeast of one or more nucleotide sequence encoding enzymes involved in the conversion of pyruvate to ethanol or another product of interest. In particular embodiments the methods ensure the stimulation of expression of one or more enzymes which allows the micro-organism to degrade cellulose, such as a cellulase. In yet further embodiments, the RNA targeting CRISPR complex is used to suppress endogenous metabolic pathways which compete with the biofuel production pathway.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species using Cas9. Using similar tools, the methods of the RNA targeting CRISPR system described herein can be applied on *Chlamydomonas* species and other algae. In particular embodiments, the RNA targeting effector protein and guide RNA are introduced in algae expressed using a vector that expresses the RNA targeting effector protein under the control of a constitutive promoter such as Hsp70A-Rbc S2 or Beta2-tubulin. Guide RNA will be delivered using a vector containing T7 promoter. Alternatively, in vitro transcribed guide RNA can be delivered to algae cells. Electroporation protocol follows standard recommended protocol from the GeneArt *Chlamydomonas* Engineering kit.

Particular Applications of the RNA Targeting Enzymes in Plants

In particular embodiments, present invention can be used as a therapy for virus removal in plant systems as it is able to cleave viral RNA. Previous studies in human systems have demonstrated the success of utilizing CRISPR in targeting the single strand RNA virus, hepatitis C (A. Price, et al., Proc. Natl. Acad. Sci, 2015). These methods may also be adapted for using the RNA targeting CRISPR system in plants.

Improved Plants

The present invention also provides plants and yeast cells obtainable and obtained by the methods provided herein. The improved plants obtained by the methods described herein may be useful in food or feed production through the modified expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

In an embodiment of the invention, a C2c2 system is used to engineer pathogen resistant plants, for example by creating resistance against diseases caused by bacteria, fungi or viruses. In certain embodiments, pathogen resistance can be accomplished by engineering crops to produce a C2c2 system that will be ingested by an insect pest, leading to mortality. In an embodiment of the invention, a C2c2 system is used to engineer abiotic stress tolerance. In another embodiment, a C2c2 system is used to engineer drought stress tolerance or salt stress tolerance, or cold or heat stress tolerance. Younis et al. 2014, Int. J. Biol. Sci. 10; 1150 reviewed potential targets of plant breeding methods, all of which are amenable to correction or improvement through use of a C2c2 system described herein. Some non-limiting target crops include *Arabidopsis Zea mays* is *thaliana, Oryza sativa* L, *Prunus domestica* L., *Gossypium hirsutum, Nicotiana rustica, Zea mays, Medicago sativa, Nicotiana benthamiana* and *Arabidopsis thaliana.*

In an embodiment of the invention, a C2c2 system is used for management of crop pests. For example, a C2c2 system operable in a crop pest can be expressed from a plant host or transferred directly to the target, for example using a viral vector.

In an embodiment, the invention provides a method of efficiently producing homozygous organisms from a heterozygous non-human starting organism. In an embodiment, the invention is used in plant breeding. In another embodiment, the invention is used in animal breeding. In such embodiments, a homozygous organism such as a plant or animal is made by preventing or suppressing recombination by interfering with at least one target gene involved in double strand breaks, chromosome pairing and/or strand exchange.

Application of the C2C2 Proteins in Optimized Functional RNA Targeting Systems

In an aspect the invention provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc. Applications of this system are described elsewhere herein.

According to one aspect the invention provides nonnaturally occurring or engineered composition comprising a guide RNA comprising a guide sequence capable of hybridizing to a target sequence in a genomic locus of interest in a cell, wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of the C2c2 enzymes described herein are shown to be amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function. In an aspect the invention provides a herein-discussed composition, wherein the composition comprises a CRISPR-Cas complex having at least three functional domains, at least one of which is associated with the RNA targeting enzyme and at least two of which are associated with the gRNA.

Accordingly, in an aspect the invention provides non-naturally occurring or engineered CRISPR-Cas complex composition comprising the guide RNA as herein-discussed and a CRISPR enzyme which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a c2c2 enzyme which has a diminished nuclease activity of at least 97%, or 100% as compared with the c2c2 enzyme not having the at least one mutation. In an aspect the invention provides a herein-discussed composition, wherein the C2c2 enzyme comprises two or more mutations. The mutations may be selected from mutations of one or more of the following amino acid residues: R597, H602, R1278, and H1283, such as for instance one or more of the following mutations: R597A, H602A, R1278A, and H1283A, according to *Leptotrichia shahii* c2c2 protein or a corresponding position in an ortholog.

In particular embodiments, an RNA targeting system is provided as described herein above comprising two or more functional domains. In particular embodiments, the two or more functional domains are heterologous functional domain. In particular embodiments, the system comprises an adaptor protein which is a fusion protein comprising a functional domain, the fusion protein optionally comprising a linker between the adaptor protein and the functional domain. In particular embodiments, the linker includes a Gly-Ser linker. Additionally or alternatively, one or more functional domains are attached to the RNA effector protein by way of a linker, optionally a Gly-Ser linker. In particular embodiments, the one or more functional domains are attached to the RNA targeting enzyme through one or both of the HEPN domains.

In an aspect the invention provides a herein-discussed composition, wherein the one or more functional domains associated with the adaptor protein or the RNA targeting enzyme is a domain capable of activating or repressing RNA translation. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility.

In an aspect the invention provides a herein-discussed composition comprising an aptamer sequence. In particular embodiments, the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from a binding protein specifically binding any one of the adaptor proteins listed above. In an aspect the invention provides a herein-discussed composition, wherein the cell is a eukaryotic cell. In an aspect the invention provides a herein-discussed composition, wherein the eukaryotic cell is a mammalian cell, a plant cell or a yeast cell, whereby the mammalian cell is optionally a mouse cell. In an aspect the invention provides a herein-discussed composition, wherein the mammalian cell is a human cell.

In an aspect the invention provides a herein above-discussed composition wherein there is more than one gRNA, and the gRNAs target different sequences whereby when the composition is employed, there is multiplexing. In an aspect the invention provides a composition wherein there is more than one gRNA modified by the insertion of distinct RNA sequence(s) that bind to one or more adaptor proteins.

In an aspect the invention provides a herein-discussed composition wherein one or more adaptor proteins associated with one or more functional domains is present and bound to the distinct RNA sequence(s) inserted into the guide RNA(s).

In an aspect the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect the invention provides a method for modifying gene expression comprising the administration to a host or expression in a host in vivo of one or more of the compositions as herein-discussed.

In an aspect the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect the invention provides a herein-discussed method wherein the expression in vivo is via a lentivirus, an adenovirus, or an AAV.

In an aspect the invention provides a mammalian cell line of cells as herein-discussed, wherein the cell line is, optionally, a human cell line or a mouse cell line. In an aspect the invention provides a transgenic mammalian model, optionally a mouse, wherein the model has been transformed with a herein-discussed composition or is a progeny of said transformant.

In an aspect the invention provides a nucleic acid molecule(s) encoding guide RNA or the RNA targeting CRISPR-Cas complex or the composition as herein-discussed. In an aspect the invention provides a vector comprising: a nucleic acid molecule encoding a guide RNA (gRNA) comprising a guide sequence capable of hybridizing to a target sequence in a genomic locus of interest in a cell, wherein the direct repeat of the gRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect the invention provides vector(s) comprising nucleic acid molecule(s) encoding: non-naturally occurring or engineered CRISPR-Cas complex composition comprising the gRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect a vector can further comprise regulatory element(s) operable in a eukaryotic cell operably linked to the nucleic acid molecule encoding the guide RNA (gRNA) and/or the nucleic acid molecule encoding the RNA targeting enzyme and/or the optional nuclear localization sequence(s).

In one aspect, the invention provides a kit comprising one or more of the components described hereinabove. In some embodiments, the kit comprises a vector system as described above and instructions for using the kit.

In an aspect the invention provides a method of screening for gain of function (GOF) or loss of function (LOF) or for screening non-coding RNAs or potential regulatory regions (e.g. enhancers, repressors) comprising the cell line of as herein-discussed or cells of the model herein-discussed containing or expressing the RNA targeting enzyme and introducing a composition as herein-discussed into cells of the cell line or model, whereby the gRNA includes either an activator or a repressor, and monitoring for GOF or LOF respectively as to those cells as to which the introduced gRNA includes an activator or as to those cells as to which the introduced gRNA includes a repressor.

In an aspect the invention provides a library of non-naturally occurring or engineered compositions, each comprising a RNA targeting CRISPR guide RNA (gRNA) comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs comprise a genome wide library comprising a plurality of RNA targeting guide RNAs (gRNAs). In an aspect the invention provides a library as herein-discussed, wherein the RNA targeting RNA targeting enzyme has a diminished nuclease activity of at least 97%, or 100% as compare with the RNA targeting enzyme not having the at least one mutation. In an aspect the invention provides a library as herein-discussed, wherein the adaptor protein is a fusion protein comprising the functional domain. In an aspect the invention provides a library as herein discussed, wherein the gRNA is not modified by the insertion of distinct RNA sequence(s) that bind to the one or two or more adaptor proteins. In an aspect the invention provides a library as herein discussed, wherein the one or two or more functional domains are associated with the RNA targeting enzyme. In an aspect the invention provides a library as herein discussed, wherein the cell population of cells is a population of eukaryotic cells. In an aspect the invention provides a library as herein discussed, wherein the eukaryotic cell is a mammalian cell, a plant cell or a yeast cell. In an aspect the invention provides a library as herein discussed, wherein the mammalian cell is a human cell. In an aspect the invention provides a library as herein discussed, wherein the population of cells is a population of embryonic stem (ES) cells.

In an aspect the invention provides a library as herein discussed, wherein the targeting is of about 100 or more RNA sequences. In an aspect the invention provides a library as herein discussed, wherein the targeting is of about 1000 or more RNA sequences. In an aspect the invention provides a library as herein discussed, wherein the targeting is of about 20,000 or more sequences. In an aspect the invention provides a library as herein discussed, wherein the targeting is of the entire transcriptome. In an aspect the invention provides a library as herein discussed, wherein the targeting is of a panel of target sequences focused on a relevant or desirable pathway. In an aspect the invention provides a library as herein discussed, wherein the pathway is an immune pathway. In an aspect the invention provides a library as herein discussed, wherein the pathway is a cell division pathway.

In one aspect, the invention provides a method of generating a model eukaryotic cell comprising a gene with modified expression. In some embodiments, a disease gene is any gene associated an increase in the risk of having or developing a disease. In some embodiments, the method comprises (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide RNA interaction with the target RNA and the RNA targeting enzyme permitting engineering or alteration of guide RNA structure to optimize functionality of the entire RNA targeting CRISPR-Cas system. For example, the guide RNA may be extended, without colliding with the RNA targeting protein by the insertion of adaptor proteins that can bind to RNA. These adaptor proteins can further recruit effector proteins or fusions which comprise one or more functional domains.

An aspect of the invention is that the above elements are comprised in a single composition or comprised in individual compositions. These compositions may advantageously be applied to a host to elicit a functional effect on the genomic level.

The skilled person will understand that modifications to the guide RNA which allow for binding of the adapter+ functional domain but not proper positioning of the adapter+ functional domain (e.g. due to steric hindrance within the three dimensional structure of the CRISPR complex) are modifications which are not intended. The one or more modified guide RNA may be modified, by introduction of a distinct RNA sequence(s) 5' of the direct repeat, within the direct repeat, or 3' of the guide sequence.

The modified guide RNA, the inactivated RNA targeting enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral gRNA selection) and concentration of gRNA (e.g. dependent on whether multiple gRNAs are used) may be advantageous for eliciting an improved effect.

Using the provided compositions, the person skilled in the art can advantageously and specifically target single or multiple loci with the same or different functional domains to elicit one or more genomic events. The compositions may be applied in a wide variety of methods for screening in libraries in cells and functional modeling in vivo (e.g. gene activation of lincRNA and identification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR RNA targeting events. (See, e.g., Platt et al., Cell (2014), http://dx.doi.org/10.1016/j.cell.2014.09.014, or PCT patent publications cited herein, such as WO 2014/093622 (PCT/US2013/074667), which are not believed prior to the present invention or application). For example, the target cell comprises RNA targeting CRISPR enzyme conditionally or inducibly (e.g. in the form of Cre dependent constructs) and/or the adapter protein conditionally or inducibly and, on expression of a vector introduced into the target cell, the vector expresses that which induces or gives rise to the condition of s RNA targeting enzyme expression and/or adaptor expression in the target cell. By applying the teaching and compositions of the current invention with the known method of creating a CRISPR complex, inducible gene expression affected by functional domains are also an aspect of the current invention. Alternatively, the adaptor protein may be provided as a conditional or inducible element with a conditional or inducible s RNA targeting enzyme to provide an effective model for screening purposes, which advantageously only requires minimal design and administration of specific gRNAs for a broad number of applications.

Guide RNA According to the Invention Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional RNA targeting as described herein, and guide RNA (gRNA) wherein the gRNA comprises a dead guide sequence whereby the gRNA is capable of hybridizing to a target sequence such that the RNA targeting CRISPR-Cas system is directed to a genomic locus of interest in a cell without detectable RNA cleavage activity of a non-mutant RNA targeting enzyme of the system. It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to an RNA target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence. For instance, cleavage of a target RNA polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA-RNA targeting specificity is the direct repeat sequence, which is to be appropriately linked to such guides. In particular, this implies that the direct repeat sequences are designed dependent on the origin of the RNA targeting enzyme. Thus, structural data available for validated dead guide sequences may be used for designing C2c2 specific equivalents. Structural similarity between, e.g., the orthologous nuclease domains HEPN of two or more C2c2 effector proteins may be used to transfer design equivalent dead guides. Thus, the dead guide herein may be appropriately modified in length and sequence to reflect such C2c2 specific equivalents, allowing for formation of the CRISPR complex and successful binding to the target RNA, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides allow to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The effectors, activators, repressors may be present in the form of fusion proteins.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment first 12 nt of the dead guide match the target sequence. In another embodiment, first 11 nt of the dead guide match the target sequence. In another embodiment, the first 10 nt of the dead guide match the target sequence. In an embodiment of the invention the first 15 nt of the dead guide does not match an off-target sequence downstream from a CRISPR motif in the regulatory region of another gene locus. In other embodiments, the first 14 nt, or the first 13 nt of the dead guide, or the first 12 nt of the guide, or the first 11 nt of the dead guide, or the first 10 nt of the dead guide, does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at the 3'-end that do not match the target sequence. Thus, a dead guide RNA that includes the first 20-28 nt, downstream of a CRISPR motif can be extended in length at the 3' end.

General Provisions

In an aspect, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. The invention provides an efficient and adaptable system for in situ hybridization.

In embodiments of the invention the terms guide sequence and guide RNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al., Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U 5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. U.S.A., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include lentiviruses and adeno-associated viruses, and types of such vectors can also be selected for targeting particular types of cells.

As used herein, the term "crRNA" or "guide RNA" or "single guide RNA" or "sgRNA" or "one or more nucleic acid components" of a Type V or Type VI CRISPR-Cas locus effector protein comprises any polynucleotide sequence having sufficient complementarity with a target nucleic acid sequence to hybridize with the target nucleic acid sequence and direct sequence-specific binding of a nucleic acid-targeting complex to the target nucleic acid sequence.

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, guides of the invention comprise non-naturally occurring nucleic acids and/or non-naturally occurring nucleotides and/or nucleotide analogs, and/or chemically modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, boranophosphate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified bases include, but are not limited to, 2-aminopurine, 5-bromo-uridine, pseudouridine ($\Psi$), $N^1$-methylpseudouridine (me$^1\Psi$), 5-methoxyuridine (5moU), inosine, 7-methylguanosine.

In certain embodiments, use is made of chemically modified guide RNAs. Examples of guide RNA chemical modifications include, without limitation, incorporation of 2'-O-methyl (M), 2'-O-methyl 3'phosphorothioate (MS), S-constrained ethyl (cEt), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015; Allerson et al., *J. Med. Chem.* 2005, 48:901-904; Bramsen et al., *Front. Genet.*, 2012, 3:154; Deng et al., *PNAS,* 2015, 112: 11870-11875; Sharma et al., *Med Chem Comm.,* 2014, 5:1454-1471; Li et al., Nature Biomedical Engineering, 2017, 1, 0066 DOI:10.1038/s41551-017-0066). Chemically modified guide RNAs further include, without limitation, RNAs with phosphorothioate linkages and locked nucleic acid (LNA) nucleotides comprising a methylene bridge between the 2' and 4' carbons of the ribose ring.

In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide RNA may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non coding RNA (ncRNA), long non-coding RNA (lncRNA), and small cytoplasmic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide RNA is selected to reduce the degree secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and P A Carr and G M Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides, preferably at least 18 nt, such that at least 19, 20, 21, 22, or more nt. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

Applicants also perform a challenge experiment to verify the RNA targeting and cleaving capability of a C2c2. This experiment closely parallels similar work in *E. coli* for the heterologous expression of StCas9 (Sapranauskas, R. et al. Nucleic Acids Res 39, 9275-9282 (2011)). Applicants introduce a plasmid containing both a PAM and a resistance gene into the heterologous *E. coli*, and then plate on the corresponding antibiotic. If there is RNA cleavage of the plasmid transcribed resistance gene, Applicants observe no viable colonies.

In further detail, the assay is as follows for a DNA target, but may be adapted accordingly for an RNA target. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5' PAM and 3' PAM library in separate transformations and transformed cells were plated separately on ampicillin plates. Recognition and subsequent cutting/interference with the plasmid renders a cell vulnerable to ampicillin and prevents growth. Approximately 12 h after transformation, all colonies formed by the test and control strains where harvested and plasmid DNA was isolated. Plasmid DNA was used as template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM.

For minimization of toxicity and off-target effect, it will be important to control the concentration of nucleic acid-targeting guide RNA delivered. Optimal concentrations of nucleic acid-targeting guide RNA can be determined by testing different concentrations in a cellular or non-human eukaryote animal model and using deep sequencing to analyze the extent of modification at potential off-target genomic loci. The concentration that gives the highest level of on-target modification while minimizing the level of off-target modification should be chosen for in vivo delivery. The nucleic acid-targeting system is derived advantageously from a Type VI CRISPR system. In some embodiments, one or more elements of a nucleic acid-targeting system is derived from a particular organism comprising an endogenous RNA-targeting system. In particular embodiments, the Type VI RNA-targeting Cas enzyme is C2c2. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In embodiments, the Type VI protein such as C2c2 as referred to herein also encompasses a homologue or an orthologue of a Type VI protein such as C2c2. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of Homologous proteins may but need not be structurally related, or are only partially structurally related. An "orthologue" of a protein as used herein is a protein of a different species which performs the same or a similar function as the protein it is an orthologue of Orthologous proteins may but need not be structurally related, or are only partially structurally related. In particular embodiments, the homologue or orthologue of a Type VI protein such as C2c2 as referred to herein has a sequence homology or identity of at least 80%, more preferably at least 85%, even more preferably at least 90%, such as for instance at least 95% with a Type VI protein such as C2c2. In further embodiments, the homologue or orthologue of a Type VI protein such as C2c2 as referred to herein has a sequence identity of at least 80%, more preferably at least 85%, even more preferably at least 90%, such as for instance at least 95% with the wild Type VI protein such as C2c2.

In an embodiment, the Type VI RNA-targeting Cas protein may be a C2c2 ortholog of an organism of a genus which includes but is not limited to *Leptotrichia, Listeria, Corynebacterium, Sutterella, Legionella, Treponema, Filifactor, Eubacterium, Streptococcus, Lactobacillus, Mycoplasma, Bacteroides, Flavivirus, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. Species of organism of such a genus can be as otherwise herein discussed.

Some methods of identifying orthologs of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to *Leptotrichia, Listeria, Corynebacterium, Sutterella, Legionella, Treponema, Filifactor, Eubacterium, Streptococcus, Lactobacillus, Mycoplasma, Bacteroides, Flavivirus, Flavobacterium*, Sphaerochaeta, Azospirillum, *Gluconacetobacter, Neisseria, Roseburia, Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genera herein mentioned or of species herein mentioned; advantageously the fragments are from CRISPR enzyme orthologs of different species.

In embodiments, the Type VI RNA-targeting effector protein, in particular the C2c2 protein as referred to herein also encompasses a functional variant of C2c2 or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type VI RNA-targeting effector protein.

In an embodiment of the invention, there is provided an effector protein which comprises an amino acid sequence having at least 80% sequence homology to the wild-type sequence of any of *Leptotrichia shahii* C2c2, *Lachnospiraceae bacterium* MA2020 C2c2, *Lachnospiraceae bacterium* NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, Listeriaceae bacterium (FSL M6-0635) C2c2, *Listeria* newyorkensis (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2.

In an embodiment of the invention, the effector protein comprises an amino acid sequence having at least 80% sequence homology to a Type VI effector protein consensus sequence including but not limited to a consensus sequence described herein.

In an embodiment of the invention, the effector protein comprises at least one HEPN domain, including but not limited to HEPN domains described herein, HEPN domains known in the art, and domains recognized to be HEPN domains by comparison to consensus sequences and motifs. Several such domains are provided herein. In one non-limiting example, a consensus sequence can be derived from the sequences of C2c2 orthologs provided herein.

In an embodiment of the invention, the effector protein comprises one or more HEPN domains comprising a RxxxxH motif sequence. The RxxxxH motif sequence can be, without limitation, from an HEPN domain described herein or an HEPN domain known in the art. RxxxxH motifs sequences further include motif sequences created by combining portions of two or more HEPN domains. As noted, consensus sequences can be derived from the sequences of the 15 orthologs disclosed in U.S. 62/432,240 (BI-10035). For example, from the above sequence alignment, the first HEPN domain comprises a R{N/H}xxxH motif whereas the second HEPN domain comprises a R{N/K}xxxH motif.

In an embodiment of the invention, a HEPN domain comprises at least one RxxxxH motif comprising the sequence of R{N/H/K}$X_1X_2X_3$H. In an embodiment of the invention, a HEPN domain comprises a RxxxxH motif comprising the sequence of R{N/H}$X_1X_2X_3$H. In an embodiment of the invention, a HEPN domain comprises the sequence of R{N/K}$X_1X_2X_3$H. In certain embodiments, $X_1$ is R, S, D, E, Q, N, G, Y, or H. In certain embodiments, $X_2$ is I, S, T, V, or L. In certain embodiments, $X_3$ is L, F, N, Y, V, I, S, D, E, or A.

Additional effectors for use according to the invention can be identified by their proximity to cas1 genes, for example, though not limited to, within the region 20 kb from the start of the cas1 gene and 20 kb from the end of the cas1 gene. In certain embodiments, the effector protein comprises at least one HEPN domain and at least 500 amino acids, and wherein the C2c2 effector protein is naturally present in a prokaryotic genome within 20 kb upstream or downstream of a Cas1 gene or a CRISPR array.

In an embodiment, nucleic acid molecule(s) encoding the Type VI RNA-targeting effector protein, in particular C2c2 or an ortholog or homolog thereof, may be codon-optimized for expression in an eukaryotic cell. A eukaryote can be as herein discussed. Nucleic acid molecule(s) can be engineered or non-naturally occurring.

In an embodiment, the Type VI RNA-targeting effector protein, in particular C2c2 or an ortholog or homolog thereof, may comprise one or more mutations (and hence nucleic acid molecule(s) coding for same may have mutation(s)). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the Type VI protein such as C2c2 or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the Type VI protein such as C2c2 or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In some embodiments, the unmodified nucleic acid-targeting effector protein may have cleavage activity. In some embodiments, the RNA-targeting effector protein may direct cleavage of one or both nucleic acid (DNA or RNA) strands at the location of or near a target sequence, such as within the target sequence and/or within the complement of the target sequence or at sequences associated with the target sequence. In some embodiments, the nucleic acid-targeting Cas protein may direct cleavage of one or both DNA or RNA strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a nucleic acid-targeting Cas protein that may be mutated with respect to a corresponding wild-type enzyme such that the mutated nucleic acid-targeting Cas protein lacks the ability to cleave RNA strands of a target polynucleotide containing a target sequence. As a further example, two or more catalytic domains of Cas (e.g. HEPN domain) may be mutated to produce a mutated Cas substantially lacking all RNA cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from the Type VI CRISPR system. Most preferably, the effector protein is a Type VI protein such as C2c2. By derived, Applicants mean that the derived enzyme is largely based, in the sense of having a high degree of sequence homology with, a wildtype enzyme, but that it has been mutated (modified) in some way as known in the art or as described herein.

Again, it will be appreciated that the terms Cas and CRISPR enzyme and CRISPR protein and Cas protein are generally used interchangeably and at all points of reference herein refer by analogy to novel CRISPR effector proteins further described in this application, unless otherwise apparent, such as by specific reference to Cas9. As mentioned above, many of the residue numberings used herein refer to the effector protein from the Type VI CRISPR locus. However, it will be appreciated that this invention includes many more effector proteins from other species of microbes. In certain embodiments, Cas may be constitutively present or inducibly present or conditionally present or administered or delivered. Cas optimization may be used to enhance function or to develop new functions, one can generate chimeric Cas proteins. And Cas may be used as a generic nucleic acid binding protein.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both DNA or RNA strands in or near (e.g., within 1, 2, 3, 4, 5, 6, 7, 8, 9, 10, 20, 50, 100, 200, 500, or more base pairs from) the target sequence. As used herein the term "sequence(s) associated with a target locus of interest" refers to sequences near the vicinity of the target sequence (e.g. within 1, 2, 3, 4, 5, 6, 7, 8, 9, 10, 20, 50, 100, 200, 500, or more base pairs from the target sequence, wherein the target sequence is comprised within a target locus of interest).

An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., C2c2) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.or.jp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid.

In some embodiments, a vector encodes a nucleic acid-targeting effector protein such as the C2c2, or an ortholog or homolog thereof comprising one or more nuclear localization sequences (NLSs) or nuclear export signals (NESs), such as about or more than about 1, 2, 3, 4, 5, 6, 7, 8, 9, 10, or more NLSs or NESs. In some embodiments, the RNA-targeting effector protein comprises about or more than about 1, 2, 3, 4, 5, 6, 7, 8, 9, 10, or more NLSs or NESs at or near the amino-terminus, about or more than about 1, 2, 3, 4, 5, 6, 7, 8, 9, 10, or more NLSs or NESs at or near the carboxy-terminus, or a combination of these (e.g., zero or at least one or more NLS or NES at the amino-terminus and zero or at one or more NLS or NES at the carboxy terminus). When more than one NLS or NES is present, each may be selected independently of the others, such that a single NLS or NES may be present in more than one copy and/or in combination with one or more other NLSs or NESs present in one or more copies. In some embodiments, an NLS or NES is considered near the N- or C-terminus when the nearest amino acid of the NLS or NES is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 27); the NLS from nucleoplasmin (e.g., the nucleoplasmin bipartite NLS with the sequence KRPAATKKAGQAKKKK (SEQ ID NO: 28)); the c-myc NLS having the amino acid sequence PAAKRVKLD (SEQ ID NO: 29) or RQRR-NELKRSP (SEQ ID NO: 30); the hRNPA1 M9 NLS having the sequence NQSSNFGPMKGGNFG-GRSSGPYGGGGQYFAKPRNQGGY (SEQ ID NO: 31); the sequence RMRIZFKNKGKDTAELRRRRVEVS-VELRKAKKDEQILKRRNV (SEQ ID NO: 32) of the IBB domain from importin-alpha; the sequences VSRKRPRP (SEQ ID NO: 33) and PPKKARED (SEQ ID NO: 34) of the myoma T protein; the sequence PQPKKKPL (SEQ ID NO: 35) of human p53; the sequence SALIKKKKKMAP (SEQ ID NO: 36) of mouse c-abl IV; the sequences DRLRR (SEQ ID NO: 37) and PKQKKRK (SEQ ID NO: 38) of the influenza virus NS1; the sequence RKLKKKIKKL (SEQ ID NO: 39) of the Hepatitis virus delta antigen; the sequence REKKKFLKRR (SEQ ID NO: 40) of the mouse Mx1 protein; the sequence KRKGDEVDGVDEVAKKKSKK (SEQ ID NO: 41) of the human poly(ADP-ribose) polymerase; and the sequence RKCLQAGMNLEARKTKK (SEQ ID NO: 42) of the steroid hormone receptors (human) glucocorticoid. In general, the one or more NLSs or NESs are of sufficient strength to drive accumulation of the DNA/RNA-targeting Cas protein in a detectable amount in respectively the nucleus or cytoplasm of a eukaryotic cell. In general, strength of nuclear/cytoplasmic localization activity may derive from the number of NLSs or NESs in the nucleic acid-targeting effector protein, the particular NLS(s) or NES(s) used, or a combination of these factors. Detection of accumulation in the nucleus/cytoplasm may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI) or cytoplasm. Cell nuclei may also be isolated from cells, the contents of which may then be analyzed by any suitable process for detecting protein, such as immunohistochemistry, Western blot, or enzyme activity assay. Accumulation in the nucleus/cytoplasm may also be determined indirectly, such as by an assay for the effect of nucleic acid-targeting complex formation (e.g., assay for RNA cleavage or mutation at the target sequence, or assay for altered gene expression activity affected by RNA-targeting complex formation and/or RNA-targeting Cas protein activity), as compared to a control not exposed to the nucleic acid-targeting Cas protein or nucleic acid-targeting complex, or exposed to a nucleic acid-targeting Cas protein lacking the one or more NLSs or NESs. In preferred embodiments of the herein described C2c2 effector protein complexes and systems the codon optimized C2c2 effector proteins comprise an NLS or NES attached to the C-terminal of the protein.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector protein or has cells containing nucleic acid-targeting effector protein, such as by way of prior administration thereto of a vector or vectors that code for and express in vivo nucleic acid-targeting effector protein. Alternatively, two or more of the elements expressed from the same or different regulatory elements, may be combined in a single vector, with one or more additional vectors providing any components of the nucleic acid-targeting system not included in the first vector. Nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. In some embodiments, a vector comprises two or more insertion sites, so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a nucleic acid-targeting effector protein. Nucleic acid-targeting effector protein or nucleic acid-targeting guide RNA or RNA(s) can be delivered separately; and advantageously at least one of these is delivered via a particle or nanoparticle complex. nucleic acid-targeting effector protein mRNA can be delivered prior to the nucleic acid-targeting guide RNA to give time for nucleic acid-targeting effector protein to be expressed. nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+guide RNA. Additional administrations of nucleic acid-targeting effector protein mRNA and/or guide RNA might be useful to achieve the most efficient levels of genome and/or transcriptome modification.

In one aspect, the invention provides methods for using one or more elements of a nucleic acid-targeting system. The nucleic acid-targeting complex of the invention provides an effective means for modifying a target RNA. The nucleic acid-targeting complex of the invention has a wide variety of utility including modifying (e.g., deleting, inserting, translocating, inactivating, activating) a target RNA in a multiplicity of cell types. As such the nucleic acid-targeting complex of the invention has a broad spectrum of applications in, e.g., gene therapy, drug screening, disease diagnosis, and prognosis. An exemplary nucleic acid-targeting complex comprises a RNA-targeting effector protein complexed with a guide RNA hybridized to a target sequence within the target locus of interest.

In one embodiment, this invention provides a method of cleaving a target RNA. The method may comprise modifying a target RNA using a nucleic acid-targeting complex that binds to the target RNA and effect cleavage of said target RNA. In an embodiment, the nucleic acid-targeting complex of the invention, when introduced into a cell, may create a break (e.g., a single or a double strand break) in the RNA sequence. For example, the method can be used to cleave a disease RNA in a cell. For example, an exogenous RNA template comprising a sequence to be integrated flanked by an upstream sequence and a downstream sequence may be introduced into a cell. The upstream and downstream sequences share sequence similarity with either side of the site of integration in the RNA. Where desired, a donor RNA can be mRNA. The exogenous RNA template comprises a sequence to be integrated (e.g., a mutated RNA). The sequence for integration may be a sequence endogenous or exogenous to the cell. Examples of a sequence to be integrated include RNA encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous RNA template are selected to promote recombination between the RNA sequence of interest and the donor RNA. The upstream sequence is a RNA sequence that shares sequence similarity with the RNA sequence upstream of the targeted site for integration. Similarly, the downstream sequence is a RNA sequence that shares sequence similarity with the RNA sequence downstream of the targeted site of integration. The upstream and downstream sequences in the exogenous RNA template can have 75%, 80%, 85%, 90%, 95%, or 100% sequence identity with the targeted RNA sequence. Preferably, the upstream and downstream sequences in the exogenous RNA template have about 95%, 96%, 97%, 98%, 99%, or 100% sequence identity with the targeted RNA sequence. In some methods, the upstream and downstream sequences in the exogenous RNA template have about 99% or 100% sequence identity with the targeted RNA sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous RNA template may further comprise a marker. Such a marker may make it easy to screen for targeted integrations. Examples of suitable markers include restriction sites, fluorescent proteins, or selectable markers. The exogenous RNA template of the invention can be constructed using recombinant techniques (see, for example, Sambrook et al., 2001 and Ausubel et al., 1996). In a method for modifying a target RNA by integrating an exogenous RNA template, a break (e.g., double or single stranded break in double or single stranded DNA or RNA) is introduced into the DNA or RNA sequence by the nucleic acid-targeting complex, the break is repaired via homologous recombination with an exogenous RNA template such that the template is integrated into the RNA target. The presence of a double-stranded break facilitates integration of the template. In other embodiments, this invention provides a method of modifying expression of a RNA in a eukaryotic cell. The method comprises increasing or decreasing expression of a target polynucleotide by using a nucleic acid-targeting complex that binds to the RNA (e.g., mRNA or pre-mRNA). In some methods, a target RNA can be inactivated to effect the modification of the expression in a cell. For example, upon the binding of a RNA-targeting complex to a target sequence in a cell, the target RNA is inactivated such that the sequence is not translated, the coded protein is not produced, or the sequence does not function as the wild-type sequence does. For example, a protein or microRNA coding sequence may be inactivated such that the protein or microRNA or pre-microRNA transcript is not produced. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA). Examples of target RNA include a sequence associated with a signaling biochemical pathway, e.g., a signaling biochemical pathway-associated RNA. Examples of target RNA include a disease associated RNA. A "disease-associated" RNA refers to any RNA which is yielding translation products at an abnormal level or in an abnormal form in cells derived from a disease-affected tissues compared with tissues or cells of a non disease control. It may be a RNA transcribed from a gene that becomes expressed at an abnormally high level; it may be a RNA transcribed from a gene that becomes expressed at an abnormally low level, where the altered expression correlates with the occurrence and/or progression of the disease. A disease-associated RNA also refers to a RNA transcribed from a gene possessing mutation(s) or genetic variation that is directly responsible or is in linkage disequilibrium with a gene(s) that is responsible for the etiology of a disease. The translated products may be known or unknown, and may be at a normal or abnormal level. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA).

In some embodiments, the method may comprise allowing a nucleic acid-targeting complex to bind to the target RNA to effect cleavage of said target RNA or RNA thereby modifying the target RNA, wherein the nucleic acid-targeting complex comprises a nucleic acid-targeting effector protein complexed with a guide RNA hybridized to a target sequence within said target RNA. In one aspect, the invention provides a method of modifying expression of RNA in a eukaryotic cell. In some embodiments, the method comprises allowing a nucleic acid-targeting complex to bind to the RNA such that said binding results in increased or decreased expression of said RNA; wherein the nucleic acid-targeting complex comprises a nucleic acid-targeting effector protein complexed with a guide RNA. Similar considerations and conditions apply as above for methods of modifying a target RNA. In fact, these sampling, culturing and re-introduction options apply across the aspects of the present invention. In one aspect, the invention provides for methods of modifying a target RNA in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

Indeed, in any aspect of the invention, the nucleic acid-targeting complex may comprise a nucleic acid-targeting effector protein complexed with a guide RNA hybridized to a target sequence.

The invention relates to the engineering and optimization of systems, methods and compositions used for the control of gene expression involving RNA sequence targeting, that relate to the nucleic acid-targeting system and components thereof. In advantageous embodiments, the effector protein enzyme is a Type VI protein such as C2c2. An advantage of the present methods is that the CRISPR system minimizes or avoids off-target binding and its resulting side effects. This is achieved using systems arranged to have a high degree of sequence specificity for the target RNA.

In relation to a nucleic acid-targeting complex or system preferably, the tracr sequence has one or more hairpins and is 30 or more nucleotides in length, 40 or more nucleotides in length, or 50 or more nucleotides in length; the crRNA sequence is between 10 to 30 nucleotides in length, the nucleic acid-targeting effector protein is a Type VI effector protein.

In certain embodiments, the effector protein may be a *Listeria* sp. C2c2p, preferably *Listeria seeligeri* C2c2p, more preferably *Listeria seeligeri* serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a *Leptotrichia* sp. C2c2p, preferably *Leptotrichia shahii* C2c2p, more preferably *Leptotrichia shahii* DSM 19757 C2c2p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

More preferably, the effector protein may be a *Leptotrichia* sp., preferably *Leptotrichia wadei* F0279, or a *Listeria* sp., preferably *Listeria newyorkensis* FSL M6-0635.

In certain embodiments, the effector protein may be a Type VI loci effector protein, more particularly a C2c2p, and the crRNA sequence may be 36 to 63 nucleotides in length, preferably 37-nt to 62-nt in length, or 38-nt to 61-nt in length, or 39-nt to 60-nt in length, more preferably 40-nt to 59-nt in length, or 41-nt to 58-nt in length, most preferably 42-nt to 57-nt in length. For example, the crRNA may comprise, consist essentially of or consist of a direct repeat (DR), preferably a 5' DR, 26-nt to 31-nt in length, preferably 27-nt to 30-nt in length, even more preferably 28-nt or 29-nt in length or at least 28 or 29 nt in length, and a spacer 10-nt to 32-nt in length, preferably 11-nt to 31-nt in length, more preferably 12-nt to 30-nt in length, even more preferably 13-nt to 29-nt in length, and most preferably 14-nt to 28-nt in length, such as 18-28 nt, 19-28 nt, 20-28 nt, 21-28 nt, or 22-28 nt.

In certain embodiments, the effector protein may be a Type VI loci effector protein, more particularly a C2c2p, and the tracrRNA sequence (if present) may be at least 60-nt long, such as at least 65-nt in length, or at least 70-nt in length, such as from 60-nt to 70-nt in length, or from 60-nt to 70-nt in length, or from 70-nt to 80-nt in length, or from 80-nt to 90-nt in length, or from 90-nt to 100-nt in length, or from 100-nt to 110-nt in length, or from 110-nt to 120-nt in length, or from 120-nt to 130-nt in length, or from 130-nt to 140-nt in length, or from 140-nt to 150-nt in length, or more than 150-nt in length.

In certain embodiments, the effector protein may be a Type VI loci effector protein, more particularly a C2c2p, and no tracrRNA may be required for cleavage.

The use of two different aptamers (each associated with a distinct nucleic acid-targeting guide RNAs) allows an activator-adaptor protein fusion and a repressor-adaptor protein fusion to be used, with different nucleic acid-targeting guide RNAs, to activate expression of one DNA or RNA, whilst repressing another. They, along with their different guide RNAs can be administered together, or substantially together, in a multiplexed approach. A large number of such modified nucleic acid-targeting guide RNAs can be used all at the same time, for example 10 or 20 or 30 and so forth, whilst only one (or at least a minimal number) of effector protein molecules need to be delivered, as a comparatively small number of effector protein molecules can be used with a large number of modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the Gly-Ser linker.

It is also envisaged that the nucleic acid-targeting effector protein-guide RNA complex as a whole may be associated with two or more functional domains. For example, there may be two or more functional domains associated with the nucleic acid-targeting effector protein, or there may be two or more functional domains associated with the guide RNA (via one or more adaptor proteins), or there may be one or more functional domains associated with the nucleic acid-targeting effector protein and one or more functional domains associated with the guide RNA (via one or more adaptor proteins).

The fusion between the adaptor protein and the activator or repressor may include a linker. For example, Gly-Ser linkers GGGS (SEQ ID NO: 48) can be used. They can be used in repeats of 3 ((GGGGS)$_3$ (SEQ ID NO: 47)) or 6 (SEQ ID NO: 49), 9 (SEQ ID NO: 50) or even 12 (SEQ ID NO: 51) or more, to provide suitable lengths, as required. Linkers can be used between the guide RNAs and the functional domain (activator or repressor), or between the nucleic acid-targeting effector protein and the functional domain (activator or repressor). The linkers the user to engineer appropriate amounts of "mechanical flexibility".

The invention comprehends a nucleic acid-targeting complex comprising a nucleic acid-targeting effector protein and a guide RNA, wherein the nucleic acid-targeting effector protein comprises at least one mutation, such that the nucleic acid-targeting Cas protein has no more than 5% of the activity of the nucleic acid-targeting Cas protein not having the at least one mutation and, optionally, at least one or more nuclear localization sequences; the guide RNA comprises a guide sequence capable of hybridizing to a target sequence in a RNA of interest in a cell; and wherein: the nucleic acid-targeting effector protein is associated with two or more functional domains; or at least one loop of the guide RNA is modified by the insertion of distinct RNA sequence(s) that bind to one or more adaptor proteins, and wherein the adaptor protein is associated with two or more functional domains; or the nucleic acid-targeting effector protein is associated with one or more functional domains and at least one loop of the guide RNA is modified by the insertion of distinct RNA sequence(s) that bind to one or more adaptor proteins, and wherein the adaptor protein is associated with one or more functional domains.

Delivery Generally

C2c2 Effector Protein Complexes can Deliver Functional Effectors

Unlike CRISPR-Cas-mediated gene knockout, which permanently eliminates expression by mutating the gene at the DNA level, CRISPR-Cas knockdown allows for temporary reduction of gene expression through the use of artificial transcription or translation factors. Mutating key residues in both DNA or RNA cleavage domains of the C2c2 protein results in the generation of a catalytically inactive C2c2. A catalytically inactive C2c2 complexes with a guide RNA and localizes to the RNA sequence specified by that guide RNA's targeting domain, however, it does not cleave the target RNA. Fusion of the inactive C2c2 protein to an effector domain, e.g., a transcription or translation repression domain, enables recruitment of the effector to any RNA site specified by the guide RNA. In certain embodiments, C2c2 may be fused to a transcriptional repression domain and recruited to the promoter region of a gene. Especially for gene repression, it is contemplated herein that blocking the binding site of an endogenous transcription factor would aid in downregulating gene expression. In another embodiment, an inactive C2c2 can be fused to a chromatin modifying protein. Altering chromatin status can result in decreased expression of the target gene. In further embodiments, C2c2 may be fused to a translation repression domain.

In an embodiment, a guide RNA molecule can be targeted to a known transcription response elements (e.g., promoters, enhancers, etc.), a known upstream activating sequence, and/or sequences of unknown or known function that are suspected of being able to control (protein) expression of the target RNA.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced. In some methods, a target polynucleotide can be inactivated to effect the modification of the expression in a cell. For example, upon the binding of a CRISPR complex to an RNA target sequence in a cell, the target polynucleotide is inactivated such that the sequence is not translated, affecting the expression level of the protein in the cell.

In particular embodiments, the CRISPR enzyme comprises one or more mutations selected from the group consisting of R597A, H602A, R1278A and H1283A and/or the one or more mutations are in the HEPN domain of the CRISPR enzyme or is a mutation as otherwise discussed herein. In some embodiments, the CRISPR enzyme has one or more mutations in a catalytic domain, wherein when transcribed, the direct repeat sequence forms a single stem loop and the guide sequence directs sequence-specific binding of a CRISPR complex to the target sequence, and wherein the enzyme further comprises a functional domain. In some embodiments, the functional domain is a. In some embodiments, the functional domain is a transcription repression domain, preferably KRAB. In some embodiments, the transcription repression domain is SID, or concatemers of SID (e.g. SID4X). In some embodiments, the functional domain is an epigenetic modifying domain, such that an epigenetic modifying enzyme is provided. In some embodiments, the functional domain is an activation domain, which may be the P65 activation domain.

Delivery of the C2c2 Effector Protein Complex or Components Thereof

Through this disclosure and the knowledge in the art, TALEs, CRISPR-Cas systems, or components thereof or nucleic acid molecules thereof or nucleic acid molecules encoding or providing components thereof may be delivered by a delivery system herein described both generally and in detail.

Vector delivery, e.g., plasmid, viral delivery: The CRISPR enzyme, for instance a Type V protein such as C2c2, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Effector proteins and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^9$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{10}$ functional AAV/ml solution. The dosage may be adjusted to balance the therapeutic benefit against any side effects. In an embodiment herein, the AAV dose is generally in the range of concentrations of from about $1\times10^5$ to $1\times10^{50}$ genomes AAV, from about $1\times10^8$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 μg to about 10 μg per 70 kg individual. Plasmids of the invention will generally comprise (i) a promoter; (ii) a sequence encoding an nucleic acid-targeting CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al. FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example, Tolentino et al., Retina 24(4):660) which may also be applied to the present invention.

Indeed, RNA delivery is a useful method of in vivo delivery. It is possible to deliver nucleic acid-targeting Cas protein Cas9 and guide RNA gRNA (and, for instance, HR repair template) into cells using liposomes or particles. Thus delivery of the nucleic acid-targeting Cas protein/CRISPR enzyme, such as a Cas9 and/or delivery of the guide RNAs of the invention may be in RNA form and via microvesicles, liposomes or particles. For example, Cas mRNA and guide RNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the RNA-targeting system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E (a-tocopherol) may be conjugated with nucleic acid-targeting Cas protein and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, Calif.) filled with phosphate-buffered saline (PBS) or free TocsiBACE or TocsiBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of nucleic acid-targeting effector protein conjugated to a-tocopherol and co-administered with HDL targeted to the brain may be contemplated for humans in the present invention, for example, about 3 nmol to about 3 µmol of nucleic acid-targeting effector protein targeted to the brain may be contemplated. Zou et al. (HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 µl of a recombinant lentivirus having a titer of $1 \times 10^9$ transducing units (TU)/ml by an intrathecal catheter. A similar dosage of nucleic acid-targeting effector protein expressed in a lentiviral vector targeted to the brain may be contemplated for humans in the present invention, for example, about 10-50 ml of nucleic acid-targeting effector protein targeted to the brain in a lentivirus having a titer of $1 \times 10^9$ transducing units (TU)/ml may be contemplated.

In terms of local delivery to the brain, this can be achieved in various ways. For instance, material can be delivered intrastriatally e.g., by injection. Injection can be performed stereotactically via a craniotomy.

Packaging and Promoters Generally

Ways to package nucleic acid-targeting effector coding nucleic acid molecules, e.g., DNA, into vectors, e.g., viral vectors, to mediate genome modification in vivo include:
  To achieve NHEJ-mediated gene knockout:
  Single Virus Vector:
  Vector containing two or more expression cassettes:
  Promoter—nucleic acid-targeting effector protein coding nucleic acid molecule-terminator
    Promoter—guide RNA1-terminator
    Promoter—guide RNA (N)-terminator (up to size limit of vector)
  Double Virus Vector:
  Vector 1 containing one expression cassette for driving the expression of nucleic acid-targeting effector protein
    Promoter—nucleic acid-targeting effector protein coding nucleic acid molecule-terminator
  Vector 2 containing one more expression cassettes for driving the expression of one or more guide RNAs
    Promoter—guide RNA1-terminator
    Promoter—guide RNA1 (N)-terminator (up to size limit of vector)
  To mediate homology-directed repair.
  In addition to the single and double virus vector approaches described above, an additional vector is used to deliver a homology-direct repair template.

The promoter used to drive nucleic acid-targeting effector protein coding nucleic acid molecule expression can include:
  AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of nucleic acid-targeting effector protein.
  For ubiquitous expression, can use promoters: CMV, CAG, CBh, PGK, SV40, Ferritin heavy or light chains, etc.
  For brain or other CNS expression, can use promoters: Synapsin I for all neurons, CaMKIIalpha for excitatory neurons, GAD67 or GAD65 or VGAT for GABAergic neurons, etc.
  For liver expression, can use Albumin promoter.
  For lung expression, can use SP-B.
  For endothelial cells, can use ICAM.
  For hematopoietic cells can use IFNbeta or CD45.
  For Osteoblasts can use OG-2.
  The promoter used to drive guide RNA can include:
  Pol III promoters such as U6 or H1
  Use of Pol II promoter and intronic cassettes to express guide RNA Adeno Associated Virus (AAV)

Nucleic acid-targeting effector protein and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome/transcriptome modification, the expression of nucleic acid-targeting effector protein can be driven by a cell-type specific promoter. For example, liver-specific expression might use the Albumin promoter and neuron-specific expression (e.g., for targeting CNS disorders) might use the Synapsin I promoter.

In terms of in vivo delivery, AAV is advantageous over other viral vectors for a couple of reasons:
  Low toxicity (this may be due to the purification method not requiring ultracentrifugation of cell particles that can activate the immune response) and
  Low probability of causing insertional mutagenesis because it doesn't integrate into the host genome.

AAV has a packaging limit of 4.5 or 4.75 Kb. This means that nucleic acid-targeting effector protein (such as a Type V protein such as C2c2) as well as a promoter and transcription terminator have to be all fit into the same viral vector. Therefore embodiments of the invention include utilizing homologs of nucleic acid-targeting effector protein that are shorter.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al., J. Virol. 82: 5887-5911 (2008)) is as follows:

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCas ES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to Opti-MEM (serum-free) media and transfection was done 4 hours later. Cells were transfected with 10 μg of lentiviral transfer plasmid (pCas ES10) and the following packaging plasmids: 5 μg of pMD2.G (VSV-g pseudotype), and 7.5 μg of psPAX2 (gag/pol/rev/tat). Transfection was done in 4 mL Opti-MEM with a cationic lipid delivery agent (50 μL Lipofectamine 2000 and 100 μL Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 μm low protein binding (PVDF) filter. They were then spun in a ultracentrifuge for 2 hours at 24,000 rpm. Viral pellets were resuspended in 50 μl of DMEM overnight at 4 C. They were then aliquoted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the nucleic acid-targeting system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used and/or adapted to the nucleic acid-targeting system of the present invention. A minimum of $2.5 \times 10^6$ CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of $2 \times 10^6$ cells/ml. Prestimulated cells may be transduced with lentiviral at a multiplicity of infection of 5 for 16 to 24 hours in 75-cm$^2$ tissue culture flasks coated with fibronectin (25 mg/cm$^2$) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571, US20040013648, US20070025970, US20090111106 and U.S. Pat. No. 7,259,015.

RNA Delivery

RNA delivery: The nucleic acid-targeting Cas protein, for instance a Type V protein such as C2c2, and/or guide RNA, can also be delivered in the form of RNA. Nucleic acid-targeting Cas protein (such as a Type VI protein such as C2c2) mRNA can be generated using in vitro transcription. For example, nucleic acid-targeting effector protein (such as a Type V protein such as C2c2) mRNA can be synthesized using a PCR cassette containing the following elements: T7_promoter-kozak sequence (GCCACC)-effector protein-3' UTR from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce possible toxicity, the nucleic acid-targeting effector protein-coding sequence and/or the guide RNA can be modified to include one or more modified nucleoside e.g., using pseudo-U or 5-Methyl-C.

mRNA delivery methods are especially promising for liver delivery currently.

Much clinical work on RNA delivery has focused on RNAi or antisense, but these systems can be adapted for delivery of RNA for implementing the present invention. References below to RNAi etc. should be read accordingly.

Particle Delivery Systems and/or Formulations:

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof.

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

Particles

CRISPR enzyme mRNA and guide RNA may be delivered simultaneously using particles or lipid envelopes; for instance, CRISPR enzyme and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature (e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (such as a Type VI protein such as C2c2) mRNA and guide RNA may be delivered simultaneously using particles or lipid envelopes.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured particles with a poly(O-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACS Nano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001.224:185-199). Doses of about 5 mg/kg are contemplated, with single or multiple doses, depending on the target tissue.

In one embodiment, particles that can deliver RNA to a cancer cell to stop tumor growth developed by Dan Anderson's lab at MIT may be used and/or adapted to the nucleic acid-targeting system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the nucleic acid-targeting system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the nucleic acid-targeting system of the present invention.

In another embodiment, lipid nanoparticles (LNPs) are contemplated. An anti-transthyretin small interfering RNA has been encapsulated in lipid nanoparticles and delivered to humans (see, e.g., Coelho et al., N Engl J Med 2013; 369:819-29), and such a system may be adapted and applied to the nucleic acid-targeting system of the present invention. Doses of about 0.01 to about 1 mg per kg of body weight administered intravenously are contemplated. Medications to reduce the risk of infusion-related reactions are contemplated, such as dexamethasone, acetaminophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding nucleic acid-targeting effector protein to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al., Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-Bis(linoleoyloxy)-3-(dimethylamino)propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al., Molecular Therapy, vol. 19, no. 12, pages 1286-2200, December 2011). A dosage of 1 μg/ml of LNP or CRISPR-Cas RNA in or associated with the LNP may be contemplated, especially for a formulation containing DLinKC2-DMA.

Preparation of LNPs and CRISPR-Cas encapsulation may be used and/or adapted from Rosin et al., Molecular Therapy, vol. 19, no. 12, pages 1286-2200, December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol)2000)succinoyl]-1,2-dimyristoyl-sn-glycol (PEG-S-DMG), and R-3-[(ω-methoxy-poly(ethylene glycol)2000) carbamoyl]-1,2-dimyristyloxypropyl-3-amine (PEG-C-DOMG) may be provided by Tekmira Pharmaceuticals (Vancouver, Canada) or synthesized. Cholesterol may be purchased from Sigma (St Louis, Mo.). The specific nucleic acid-targeting complex (CRISPR-Cas) RNA may be encapsulated in LNPs containing DLinDAP, DLinDMA, DLinK-DMA, and DLinKC2-DMA (cationic lipid:DSPC:CHOL:PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Particle size distribution may be determined by dynamic light scattering using a NICOMP 370 particle sizer, the vesicle/intensity modes, and Gaussian fitting (Nicomp Particle Sizing, Santa Barbara, Calif.). The particle size for all three LNP systems may be ~70 nm in diameter. RNA encapsulation efficiency may be determined by removal of free RNA using Viva®PureD MiniH columns (Sartorius Stedim Biotech) from samples collected before and after dialysis. The encapsulated RNA may be extracted from the eluted particles and quantified at 260 nm. RNA to lipid ratio was determined by measurement of cholesterol content in vesicles using the Cholesterol E enzymatic assay from Wako Chemicals USA (Richmond, Va.). In conjunction with the herein discussion of LNPs and PEG lipids, PEGylated liposomes or LNPs are likewise suitable for delivery of a nucleic acid-targeting system or components thereof.

Preparation of large LNPs may be used and/or or adapted from Rosin et al., Molecular Therapy, vol. 19, no. 12, pages 1286-2200, December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/1, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at a RNA to total lipid ratio of approximately 1:10 (wt:wt), followed by incubation for 30 minutes at 37° C. to form loaded LNPs. The mixture may be subsequently dialyzed overnight in PBS and filtered with a 0.45 m syringe filter.

Spherical Nucleic Acid (SNA™) constructs and other particles (particularly gold particles) are also contemplated as a means to deliver nucleic acid-targeting system to intended targets. Significant data show that AuraSense Therapeutics' Spherical Nucleic Acid (SNA™) constructs, based upon nucleic acid-functionalized gold particles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638, Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling particles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGFR2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of nucleic acid-targeting complex RNA is envisioned for delivery in the self-assembling particles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHS ester) was ordered from Macrocyclics (Dallas, Tex.). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, Calif.) to remove trace metal contaminants. Tf-targeted and nontargeted siRNA particles may be formed by using cyclodextrin-containing polycations. Typically, particles were formed in water at a charge ratio of 3 (+/−) and an siRNA concentration of 0.5 g/liter. One percent of the adamantane-PEG molecules on the surface of the targeted particles were modified with Tf (adamantane-PEG-Tf). The particles were suspended in a 5% (wt/vol) glucose carrier solution for injection.

Davis et al. (Nature, Vol 464, 15 Apr. 2010) conducts a RNA clinical trial that uses a targeted particle-delivery system (clinical trial registration number NCT00689065). Patients with solid cancers refractory to standard-of-care therapies are administered doses of targeted particles on days 1, 3, 8 and 10 of a 21-day cycle by a 30-min intravenous infusion. The particles comprise, consist essentially of, or consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These particles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m$^{-2}$ siRNA, respectively. Similar doses may also be contemplated for the nucleic acid-targeting system of the present invention. The delivery of the invention may be achieved with particles containing a linear, cyclodextrin-based polymer (CDP), a human transferrin protein (TF) targeting ligand displayed on the exterior of the particle to engage TF receptors (TFR) on the surface of the cancer cells and/or a hydrophilic polymer (for example, polyethylene glycol (PEG) used to promote particle stability in biological fluids).

In terms of this invention, it is preferred to have one or more components of nucleic acid-targeting complex, e.g., nucleic acid-targeting effector protein or mRNA, or guide RNA delivered using particles or lipid envelopes. Other delivery systems or vectors are may be used in conjunction with the particle aspects of the invention.

In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, particles of the invention have a greatest dimension of 100 nm or less. In other preferred embodiments, nanoparticles of the invention have a greatest dimension ranging between 35 nm and 60 nm.

Particles encompassed in the present invention may be provided in different forms, e.g., as solid particles (e.g., metal such as silver, gold, iron, titanium), non-metal, lipid-based solids, polymers), suspensions of particles, or combinations thereof. Metal, dielectric, and semiconductor particles may be prepared, as well as hybrid structures (e.g., core-shell particles). Particles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft particles have been manufactured, and are within the scope of the present invention. A prototype particle of semi-solid nature is the liposome. Various types of liposome particles are currently used clinically as delivery systems for anticancer drugs and vaccines. Particles with one half hydrophilic and the other half hydrophobic are termed Janus particles and are particularly effective for stabilizing emulsions. They can self-assemble at water/oil interfaces and act as solid surfactants.

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid.

U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material.

U.S. Pat. No. 5,855,913, incorporated herein by reference, provides a particulate composition having aerodynamically light particles having a tap density of less than 0.4 g/cm3 with a mean diameter of between 5 µm and 30 µm, incorporating a surfactant on the surface thereof for drug delivery to the pulmonary system.

U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system.

U.S. Pat. No. 5,543,158, incorporated herein by reference, provides biodegradable injectable particles having a biodegradable solid core containing a biologically active material and poly(alkylene glycol) moieties on the surface.

WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such methods and materials of herein-cited documents, e.g., conjugated lipomers can be used in the context of the nucleic acid-targeting system to achieve in vitro, ex vivo and in vivo genomic perturbations to modify gene expression, including modulation of protein expression.

In one embodiment, the particle may be epoxide-modified lipid-polymer, advantageously 7C1 (see, e.g., James E. Dahlman and Carmen Barnes et al. Nature Nanotechnology (2014) published online 11 May 2014, doi:10.1038/nnano.2014.84). C71 was synthesized by reacting C15 epoxide-terminated lipids with PEI600 at a 14:1 molar ratio, and was formulated with C14 PEG2000 to produce particles (diameter between 35 and 60 nm) that were stable in PBS solution for at least 40 days.

An epoxide-modified lipid-polymer may be utilized to deliver the nucleic acid-targeting system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by particle tracking analysis (NTA) and electron microscopy. Alvarez-Erviti et al. obtained 6-12 µg of exosomes (measured based on protein concentration) per $10^6$ cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 µF resulted in the greatest retention of RNA and was used for all subsequent experiments.

Alvarez-Erviti et al. administered 150 µg of each BACE1 siRNA encapsulated in 150 µg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3D after administration and a significant protein knockdown (45%, P<0.05, versus 62%, P<0.01) in both siRNA-RVG-9R-treated and siRNA-RVG exosome-treated mice was observed, resulting from a significant decrease in BACE1 mRNA levels (66% [+ or −] 15%, P<0.001 and 61% [+ or −] 13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the β-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the nucleic acid-targeting system of the present invention to therapeutic targets, especially neurodegenerative diseases. A dosage of about 100 to 1000 mg of nucleic acid-targeting system encapsulated in about 100 to 1000 mg of RVG exosomes may be contemplated for the present invention.

El-Andaloussi et al. (Nature Protocols 7, 2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Qiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of nucleic acid-targeting system into exosomes may be conducted similarly to siRNA. The exosomes may be co-cultured with monocytes and lymphocytes isolated from the peripheral blood of healthy donors. Therefore, it may be contemplated that exosomes containing nucleic acid-targeting system may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm (see, e.g., Spuch and Navarro, Journal of Drug Delivery, vol. 2011, Article ID 469679, 12 pages, 2011. doi:10.1155/2011/469679 for review).

A liposome formulation may be mainly comprised of natural phospholipids and lipids such as 1,2-distearoyl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at http://cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the nucleic acid-targeting system or components thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific nucleic acid-targeting system targeted in a SNALP are contemplated. The daily treatment may be over about three days and then weekly for about five weeks. In another embodiment, a specific nucleic acid-targeting system encapsulated SNALP administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(o-methoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, Mo., USA), dipalmitoylphosphatidylcholine (Avanti Polar Lipids, Alabaster, Ala., USA), 3-N-[(o-methoxy poly(ethylene glycol) 2000)carbamoyl]-1,2-dimyristyloxypropylamine, and cationic 1,2-dilinoleyloxy-3-N,N-dimethylaminopropane (see, e.g., Geisbert et al., Lancet 2010; 375: 1896-905). A dosage of about 2 mg/kg total nucleic acid-targeting system per dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N,N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC) both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Biotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM $Na_2HIPO_4$, 1 mM $KH_2PO_4$, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 m filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the nucleic acid-targeting system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate nucleic acid-targeting system or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11±0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the nucleic acid-targeting system of the present invention or component(s) thereof or nucleic acid molecule(s) coding therefor to form lipid nanoparticles (LNPs). Lipids include, but are not limited to, DLin-KC2-DMA4, $C_{12-200}$ and colipids distearoylphosphatidyl choline, cholesterol, and PEG-DMG may be formulated with RNA-targeting system instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or $C_{12-200}$/distearoylphosphatidyl choline/cholesterol/PEG-DMG). The final lipid:siRNA weight ratio may be ~12:1 and 9:1 in the case of DLin-KC2-DMA and $C_{12-200}$ lipid particles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos. 1766035; 1519714; 1781593 and 1664316), all of which may be used and/or adapted to the present invention.

The nucleic acid-targeting system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to, PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesized from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropyleneimine dendrimers start from a diaminobutane core to which is added twice the number of amino groups by a double Michael addition of acrylonitrile to the primary amines followed by the hydrogenation of the nitriles. This results in a doubling of the amino groups. Polypropyleneimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine and phosphorous containing compounds with a mixture of amine/amide or N—P(O$_2$)S as the conjugating units respectively with no work being reported on the use of the lower generation polypropyleneimine dendrimers for gene delivery. Polypropyleneimine dendrimers have also been studied as pH sensitive controlled release systems for drug delivery and for their encapsulation of guest molecules when chemically modified by peripheral amino acid groups. The cytotoxicity and interaction of polypropyleneimine dendrimers with DNA as well as the transfection efficacy of DAB 64 has also been studied.

US Patent Publication No. 20050019923 is based upon the observation that, contrary to earlier reports, cationic dendrimers, such as polypropyleneimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of nucleic acid-targeting system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of nucleic acid-targeting system(s) or component(s) thereof or nucleic acid molecule(s) coding therefor. Both super negatively and super positively charged proteins exhibit a remarkable ability to withstand thermally or chemically induced aggregation. Super positively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other super positively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and RNA should be performed to optimize the procedure for specific cell lines.

(1) One day before treatment, plate 1×10$^5$ cells per well in a 48-well plate.

(2) On the day of treatment, dilute purified +36 GFP protein in serum-free media to a final concentration 200 nM. Add RNA to a final concentration of 50 nM. Vortex to mix and incubate at room temperature for 10 min.

(3) During incubation, aspirate media from cells and wash once with PBS.

(4) Following incubation of +36 GFP and RNA, add the protein-RNA complexes to cells.

(5) Incubate cells with complexes at 37° C. for 4 h.

(6) Following incubation, aspirate the media and wash three times with 20 U/mL heparin PBS. Incubate cells with serum-containing media for a further 48 h or longer depending upon the assay for activity.

(7) Analyze cells by immunoblot, qPCR, phenotypic assay, or other appropriate method.

David Liu's lab has further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications.

(1) One day before treatment, plate 1×10$^5$ per well in a 48-well plate.

(2) On the day of treatment, dilute purified +36 GFP protein in serum-free media to a final concentration 2 mM. Add 1 mg of plasmid DNA. Vortex to mix and incubate at room temperature for 10 min.

(3) During incubation, aspirate media from cells and wash once with PBS.

(4) Following incubation of 36 GFP and plasmid DNA, gently add the protein-DNA complexes to cells.

(5) Incubate cells with complexes at 370 C for 4 h.

(6) Following incubation, aspirate the media and wash with PBS. Incubate cells in serum-containing media and incubate for a further 24-48 h.

(7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the nucleic acid-targeting system of the present invention. These systems of Dr. Lui and documents herein in conjunction with herein teachings can be employed in the delivery of nucleic acid-targeting system(s) or component(s) thereof or nucleic acid molecule(s) coding therefor.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles including nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intraarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R)$_4$ (Ahx=aminohexanoyl) (SEQ ID NO: 52).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Implantable Devices

In another embodiment, implantable devices are also contemplated for delivery of the nucleic acid-targeting system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used and/or adapted to the nucleic acid-targeting system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure.

US Patent Publication 20110195123, provides a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123.

The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 m$^3$ to 1000 mm$^3$, as required by the volume for the agent load. The Loder may optionally be larger, for example when incorporated with a device whose size is determined by functionality, for example and without limitation, a knee joint, an intra-uterine or cervical ring and the like.

The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period.

The drug delivery system optionally and preferably is designed to shield the nucleotide based therapeutic agent from degradation, whether chemical in nature or due to attack from enzymes and other factors in the body of the subject.

The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices.

According to some embodiments of US Patent Publication 20110195123, the site for local delivery may optionally include target sites characterized by high abnormal proliferation of cells, and suppressed apoptosis, including tumors, active and/or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle.

The site for implantation of the composition, or target site, preferably features a radius, area and/or volume that is sufficiently small for targeted local delivery. For example, the target site optionally has a diameter in a range of from about 0.1 mm to about 5 cm.

The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof.

For example the composition (optionally with the device) is optionally implanted within or in the proximity to pancreas, prostate, breast, liver, via the nipple, within the vascular system and so forth.

The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear-auditory system, labyrinth of the inner ear, vestibular system; 11. Intra tracheal; 12. Intracardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site.

Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to other embodiments of US Patent Publication 20110195123, the drug preferably comprises a RNA, for example for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the nucleic acid-targeting system of the present invention.

As another example of a specific application, neuro and muscular degenerative diseases develop due to abnormal gene expression. Local delivery of RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately. All of this may be used and/or adapted to the nucleic acid-targeting system of the present invention.

As yet another example of a specific application, psychiatric and cognitive disorders are treated with gene modifiers. Gene knockdown is a treatment option. Loders locally delivering agents to central nervous system sites are therapeutic options for psychiatric and cognitive disorders including but not limited to psychosis, bi-polar diseases, neurotic disorders and behavioral maladies. The Loders could also deliver locally drugs including small drugs and macromolecules upon implantation at specific brain sites. All of this may be used and/or adapted to the nucleic acid-targeting system of the present invention.

As another example of a specific application, silencing of innate and/or adaptive immune mediators at local sites enables the prevention of organ transplant rejection. Local delivery of RNAs and immunomodulating reagents with the Loder implanted into the transplanted organ and/or the implanted site renders local immune suppression by repelling immune cells such as CD8 activated against the transplanted organ. All of this may be used and/or adapted to the nucleic acid-targeting system of the present invention.

As another example of a specific application, vascular growth factors including VEGFs and angiogenin and others are essential for neovascularization. Local delivery of the factors, peptides, peptidomimetics, or suppressing their repressors is an important therapeutic modality; silencing the repressors and local delivery of the factors, peptides, macromolecules and small drugs stimulating angiogenesis with the Loder is therapeutic for peripheral, systemic and cardiac vascular disease.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

Implantable device technology herein discussed can be employed with herein teachings and hence by this disclosure and the knowledge in the art, CRISPR-Cas system or components thereof or nucleic acid molecules thereof or encoding or providing components may be delivered via an implantable device.

Patient-Specific Screening Methods

A nucleic acid-targeting system that targets RNA, e.g., trinucleotide repeats can be used to screen patients or patent samples for the presence of such repeats. The repeats can be the target of the RNA of the nucleic acid-targeting system, and if there is binding thereto by the nucleic acid-targeting system, that binding can be detected, to thereby indicate that such a repeat is present. Thus, a nucleic acid-targeting system can be used to screen patients or patient samples for the presence of the repeat. The patient can then be administered suitable compound(s) to address the condition; or, can be administered a nucleic acid-targeting system to bind to and cause insertion, deletion or mutation and alleviate the condition.

The invention uses nucleic acids to bind target RNA sequences.

CRISPR Effector Protein mRNA and Guide RNA

CRISPR effector protein mRNA and guide RNA might also be delivered separately. CRISPR effector protein mRNA can be delivered prior to the guide RNA to give time for CRISPR effector protein to be expressed. CRISPR effector protein mRNA might be administered 1-12 hours (preferably around 2-6 hours) prior to the administration of guide RNA.

Alternatively, CRISPR effector protein mRNA and guide RNA can be administered together. Advantageously, a second booster dose of guide RNA can be administered 1-12 hours (preferably around 2-6 hours) after the initial administration of CRISPR effector protein mRNA+guide RNA.

The CRISPR effector protein of the present invention, i.e. a C2c2 effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have DNA or RNA binding, but not necessarily cutting or nicking, activity, including a dead-Cas effector protein function.

Additional administrations of CRISPR effector protein mRNA and/or guide RNA might be useful to achieve the most efficient levels of genome modification. In some embodiments, phenotypic alteration is preferably the result of genome modification when a genetic disease is targeted, especially in methods of therapy and preferably where a repair template is provided to correct or alter the phenotype.

In some embodiments diseases that may be targeted include those concerned with disease-causing splice defects.

In some embodiments, cellular targets include Hemopoietic Stem/Progenitor Cells (CD34+); Human T cells; and Eye (retinal cells)—for example photoreceptor precursor cells.

In some embodiments Gene targets include: Human Beta Globin—HBB (for treating Sickle Cell Anemia, including by stimulating gene-conversion (using closely related HBD gene as an endogenous template)); CD3 (T-Cells); and CEP920—retina (eye).

In some embodiments disease targets also include: cancer; Sickle Cell Anemia (based on a point mutation); HIV; Beta-Thalassemia; and ophthalmic or ocular disease—for example Leber Congenital Amaurosis (LCA)-causing Splice Defect.

In some embodiments delivery methods include: Cationic Lipid Mediated "direct" delivery of Enzyme-Guide complex (ribonucleoprotein) and electroporation of plasmid DNA.

Inventive methods can further comprise delivery of templates, such as repair templates, which may be dsODN or ssODN, see below. Delivery of templates may be via the cotemporaneous or separate from delivery of any or all the CRISPR effector protein or guide and via the same delivery mechanism or different. In some embodiments, it is preferred that the template is delivered together with the guide, and, preferably, also the CRISPR effector protein. An example may be an AAV vector.

Inventive methods can further comprise: (a) delivering to the cell a double-stranded oligodeoxynucleotide (dsODN) comprising overhangs complimentary to the overhangs created by said double strand break, wherein said dsODN is integrated into the locus of interest; or—(b) delivering to the cell a single-stranded oligodeoxynucleotide (ssODN), wherein said ssODN acts as a template for homology directed repair of said double strand break. Inventive methods can be for the prevention or treatment of disease in an individual, optionally wherein said disease is caused by a defect in said locus of interest. Inventive methods can be conducted in vivo in the individual or ex vivo on a cell taken from the individual, optionally wherein said cell is returned to the individual.

For minimization of toxicity and off-target effect, it will be important to control the concentration of CRISPR effector protein mRNA and guide RNA delivered. Optimal concentrations of CRISPR effector protein mRNA and guide RNA can be determined by testing different concentrations in a cellular or animal model and using deep sequencing the analyze the extent of modification at potential off-target genomic loci. For example, for the guide sequence targeting 5'-GAGTCCGAGCAGAAGAAGAA-3' (SEQ ID NO: 53) in the EMX1 gene of the human genome, deep sequencing can be used to assess the level of modification at the following two off-target loci, 1: 5'-GAGTCCTAGCAG- GAGAAGAA-3' (SEQ ID NO: 54) and 2: 5'-GAGTCTAAGCAGAAGAAGAA-3' (SEQ ID NO: 55). The concentration that gives the highest level of on-target modification while minimizing the level of off-target modification should be chosen for in vivo delivery.

Inducible Systems

In some embodiments, a CRISPR effector protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc.), or light inducible systems (Phytochrome, LOV domains, or cryptochrome). In one embodiment, the CRISPR effector protein may be a part of a Light Inducible Transcriptional Effector (LITE) to direct changes in transcriptional activity in a sequence-specific manner. The components of a light may include a CRISPR effector protein, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, and WO 2014018423 A2 which is hereby incorporated by reference in its entirety.

Exemplary Methods of Using of CRISPR Cas System

The invention provides a non-naturally occurring or engineered composition, or one or more polynucleotides encoding components of said composition, or vector or delivery systems comprising one or more polynucleotides encoding components of said composition for use in a modifying a target cell in vivo, ex vivo or in vitro and, may be conducted in a manner alters the cell such that once modified the progeny or cell line of the CRISPR modified cell retains the altered phenotype. The modified cells and progeny may be part of a multi-cellular organism such as a plant or animal with ex vivo or in vivo application of CRISPR system to desired cell types. The CRISPR invention may be a therapeutic method of treatment. The therapeutic method of treatment may comprise gene or genome editing, or gene therapy.

Modifying a Target with CRISPR Cas System or Complex (e.g., C2c2-RNA Complex)

In one aspect, the invention provides for methods of modifying a target polynucleotide in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

In some embodiments, the method comprises allowing a CRISPR complex to bind to the target polynucleotide to effect cleavage of said target polynucleotide thereby modifying the target polynucleotide, wherein the CRISPR complex comprises a CRISPR effector protein complexed with a guide sequence hybridized or hybridizable to a target sequence within said target polynucleotide.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR effector protein complexed with a guide sequence hybridized or hybridizable to a target sequence within said polynucleotide. Similar considerations and conditions apply as above for methods of modifying a target polynucleotide. In fact, these sampling, culturing and re-introduction options apply across the aspects of the present invention.

Indeed, in any aspect of the invention, the CRISPR complex may comprise a CRISPR effector protein complexed with a guide sequence hybridized or hybridizable to a target sequence. Similar considerations and conditions apply as above for methods of modifying a target polynucleotide.

Thus in any of the non-naturally-occurring CRISPR effector proteins described herein comprise at least one modification and whereby the effector protein has certain improved capabilities. In particular, any of the effector proteins are capable of forming a CRISPR complex with a guide RNA. When such a complex forms, the guide RNA is capable of binding to a target polynucleotide sequence and the effector protein is capable of modifying a target locus. In addition, the effector protein in the CRISPR complex has reduced capability of modifying one or more off-target loci as compared to an unmodified enzyme/effector protein.

In addition, the modified CRISPR enzymes described herein encompass enzymes whereby in the CRISPR complex the effector protein has increased capability of modifying the one or more target loci as compared to an unmodified enzyme/effector protein. Such function may be provided separate to or provided in combination with the above-described function of reduced capability of modifying one or more off-target loci. Any such effector proteins may be provided with any of the further modifications to the CRISPR effector protein as described herein, such as in combination with any activity provided by one or more associated heterologous functional domains, any further mutations to reduce nuclease activity and the like.

In advantageous embodiments of the invention, the modified CRISPR effector protein is provided with reduced capability of modifying one or more off-target loci as compared to an unmodified enzyme/effector protein and increased capability of modifying the one or more target loci as compared to an unmodified enzyme/effector protein. In combination with further modifications to the effector protein, significantly enhanced specificity may be achieved. For example, combination of such advantageous embodiments with one or more additional mutations is provided wherein the one or more additional mutations are in one or more catalytically active domains. In such effector proteins, enhanced specificity may be achieved due to an improved specificity in terms of effector protein activity.

Additional functionalities which may be engineered into modified CRISPR effector proteins as described herein include the following. 1. Modified CRISPR effector proteins that disrupt RNA:protein interactions without affecting protein tertiary or secondary structure. This includes residues that contact any part of the RNA:RNA duplex. 2. Modified CRISPR effector proteins that weaken intra-protein interactions holding C2c2 in conformation essential for nuclease cutting in response to RNA binding (on or off target). For example: a modification that mildly inhibits, but still allows, the nuclease conformation of the HNH domain (positioned at the scissile phosphate). 3. Modified CRISPR effector proteins that strengthen intra-protein interactions holding C2c2 in a conformation inhibiting nuclease activity in response to RNA binding (on or off targets). For example: a modification that stabilizes the HNH domain in a conformation away from the scissile phosphate. Any such additional functional enhancement may be provided in combination with any other modification to the CRISPR effector protein as described in detail elsewhere herein.

Any of the herein described improved functionalities may be made to any CRISPR effector protein, such as a C2c2 effector protein. However, it will be appreciated that any of the functionalities described herein may be engineered into C2c2 effector proteins from other orthologs, including chimeric effector proteins comprising fragments from multiple orthologs.

The invention uses nucleic acids to bind target DNA sequences. This is advantageous as nucleic acids are much easier and cheaper to produce than proteins, and the specificity can be varied according to the length of the stretch where homology is sought. Complex 3-D positioning of multiple fingers, for example is not required. The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 500 C below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogsteen binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

In aspects of the invention the term "guide RNA", refers to the polynucleotide sequence comprising one or more of a putative or identified tracr sequence and a putative or identified crRNA sequence or guide sequence. In particular embodiments, the "guide RNA" comprises a putative or identified crRNA sequence or guide sequence. In further embodiments, the guide RNA does not comprise a putative or identified tracr sequence.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A.; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 *Nuc. Acids Research* 12 p. 387). Examples of other software than may perform sequence comparisons include, but are not limited to, the BLAST package (see Ausubel et al., 1999 *Short Protocols in Molecular Biology*, 4$^{th}$ Ed. —Chapter 18), FASTA (Altschul et al., 1990 *J. Mol. Biol.* 403-410) and the GENEWORKS suite of comparison tools. Both BLAST and FASTA are available for offline and online searching (see Ausubel et al., 1999, *Short Protocols in Molecular Biology*, pages 7-58 to 7-60). However, for some applications, it is preferred to use the GCG Bestfit program. A new tool, called BLAST 2 Sequences is also available for comparing protein and nucleotide sequences (see *FEMS Microbiol Lett.* 1999 174 (2): 247-50; *FEMS Microbiol Lett.* 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" *Comput. Appl. Biosci.* 9: 745-756) (Taylor W. R. (1986) "The classification of amino acid conservation" *J. Theor. Biol.* 119; 205-218). Conservative substitutions may be made, for example according to the table below which describes a generally accepted Venn diagram grouping of amino acids.

| Set | | Sub-set | |
|---|---|---|---|
| Hydrophobic | F W Y H K M I L V A G C | Aromatic | F W Y H |
| | | Aliphatic | I L V |
| Polar | W Y H K R E D C S T N Q | Charged | H K R E D |
| | | Positively charged | H K R |
| | | Negatively charged | E D |
| Small | V C A G S P T N D | Tiny | A G S |

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)).

Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyridyl-alanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or P-alanine residues. A further form of variation, which involves the presence of one or more amino acid residues in peptoid form, may be well understood by those skilled in the art. For the avoidance of doubt, "the peptoid form" is used to refer to variant amino acid residues wherein the a-carbon substituent group is on the residue's nitrogen atom rather than the α-carbon. Processes for preparing peptides in the peptoid form are known in the art, for example Simon R J et al., *PNAS* (1992) 89(20), 9367-9371 and Horwell D C, *Trends Biotechnol.* (1995) 13(4), 132-134.

Homology modelling: Corresponding residues in other C2c2 orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair of query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as AmpliTaq Gold™, T7 DNA polymerase, Klenow fragment of *E. coli* DNA polymerase, and reverse transcriptase. A preferred amplification method is PCR.

In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

Aspects of the invention relate to bicistronic vectors for guide RNA and wild type, modified or mutated CRISPR effector proteins/enzymes (e.g. C2c2). Bicistronic expression vectors guide RNA and wild type, modified or mutated CRISPR effector proteins/enzymes (e.g. C2c2) are preferred. In general and particularly in this embodiment and wild type, modified or mutated CRISPR effector proteins/enzymes (e.g. C2c2) is preferably driven by the CBh promoter. The RNA may preferably be driven by a Pol III promoter, such as a U6 promoter. Ideally the two are combined.

In some embodiments, a loop in the guide RNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al., Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U 5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. U.S.A., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as Escherichia coli, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in Escherichia coli with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) Gene 69:301-315) and pET lid (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector. Examples of vectors for expression in yeast *Saccharomyces cerevisiae* include pYepSec1 (Baldari, et al., 1987. *EMBO J.* 6: 229-234), pMFa (Kuijan and Herskowitz, 1982. *Cell* 30: 933-943), pJRY88 (Schultz et al., 1987. *Gene* 54: 113-123), pYES2 (Invitrogen Corporation, San Diego, Calif.), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Luckow and Summers, 1989. *Virology* 170: 31-39).

In some embodiments, a vector is capable of driving expression of one or more sequences in mammalian cells using a mammalian expression vector. Examples of mammalian expression vectors include pCDM8 (Seed, 1987. Nature 329: 840) and pMT2PC (Kaufman, et al., 1987. *EMBO J.* 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374-379) and the a-fetoprotein promoter (Campes and Tilghman, 1989. *Genes Dev.* 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety.

In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to Aeropyrum, *Pyrobaculum, Sulfolobus, Archaeoglobus, Haloarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azoarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema*, and *Thermotoga*.

In general, "nucleic acid-targeting system" as used in the present application refers collectively to transcripts and other elements involved in the expression of or directing the activity of nucleic acid-targeting CRISPR-associated ("Cas") genes (also referred to herein as an effector protein), including sequences encoding a nucleic acid-targeting Cas (effector) protein and a guide RNA (comprising crRNA sequence and a trans-activating CRISPR/Cas system RNA (tracrRNA) sequence), or other sequences and transcripts from a nucleic acid-targeting CRISPR locus. In some embodiments, one or more elements of a nucleic acid-targeting system are derived from a Type V/Type VI nucleic acid-targeting CRISPR system. In some embodiments, one or more elements of a nucleic acid-targeting system is derived from a particular organism comprising an endogenous nucleic acid-targeting CRISPR system. In general, a nucleic acid-targeting system is characterized by elements that promote the formation of a nucleic acid-targeting complex at the site of a target sequence. In the context of formation of a nucleic acid-targeting complex, "target sequence" refers to a sequence to which a guide sequence is designed to have complementarity, where hybridization between a target sequence and a guide RNA promotes the formation of a DNA or RNA-targeting complex. Full complementarity is not necessarily required, provided there is sufficient complementarity to cause hybridization and promote formation of a nucleic acid-targeting complex. A target sequence may comprise RNA polynucleotides. In some embodiments, a target sequence is located in the nucleus or cytoplasm of a cell. In some embodiments, the target sequence may be within an organelle of a eukaryotic cell, for example, mitochondrion or chloroplast. A sequence or template that may be used for recombination into the targeted locus comprising the target sequences is referred to as an "editing template" or "editing RNA" or "editing sequence". In aspects of the invention, an exogenous template RNA may be referred to as an editing template. In an aspect of the invention the recombination is homologous recombination.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both RNA strands in or near (e.g. within 1, 2, 3, 4, 5, 6, 7, 8, 9, 10, 20, 50, or more base pairs from) the target sequence. In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector protein and a guide RNA could each be operably linked to separate regulatory elements on separate vectors. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and a guide RNA embedded within one or more intron sequences (e.g. each in a different intron, two or more in at least one intron, or all in a single intron). In some embodiments, the nucleic acid-targeting effector protein and guide RNA are operably linked to and expressed from the same promoter.

In general, a guide sequence is any polynucleotide sequence having sufficient complementarity with a target polynucleotide sequence to hybridize with the target sequence and direct sequence-specific binding of a nucleic acid-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.)), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a nucleic acid-targeting complex to a target sequence may be assessed by any suitable assay. For example, the components of a nucleic acid-targeting system sufficient to form a nucleic acid-targeting complex, including the guide sequence to be tested, may be provided to a host cell having the corresponding target sequence, such as by transfection with vectors encoding the components of the nucleic acid-targeting CRISPR sequence, followed by an assessment of preferential cleavage within or in the vicinity of the target sequence, such as by Surveyor assay as described herein. Similarly, cleavage of a target polynucleotide sequence (or a sequence in the vicinity thereof) may be evaluated in a test tube by providing the target sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art.

A guide sequence may be selected to target any target sequence. In some embodiments, the target sequence is a sequence within a gene transcript or mRNA.

In some embodiments, the target sequence is a sequence within a genome of a cell.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, Cell 106(1): 23-24; and P A Carr and G M Church, 2009, *Nature Biotechnology* 27(12): 1151-62). Further algorithms may be found in WO 2014/093709, incorporated herein by reference.

In some embodiments, the nucleic acid-targeting effector protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR effector protein/enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR effector protein/enzyme fusion protein may comprise any additional protein sequence, and optionally a linker sequence between any two domains. Examples of protein domains that may be fused to an effector protein include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A nucleic acid-targeting effector protein may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) VP16 protein fusions. Additional domains that may form part of a fusion protein comprising a nucleic acid-targeting effector protein are described in US20110059502, incorporated herein by reference. In some embodiments, a tagged nucleic acid-targeting effector protein is used to identify the location of a target sequence.

In some embodiments, a CRISPR enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc.), or light inducible systems (Phytochrome, LOV domains, or cryptochrome). In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283 and WO 2014/018423 and U.S. Pat. Nos. 8,889,418, 8,895,308, US20140186919, US20140242700, US20140273234, US20140335620, WO2014093635, which is hereby incorporated by reference in its entirety.

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a nucleic acid-targeting effector protein in combination with (and optionally complexed with) a guide RNA is delivered to a cell. Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355 and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, *Science* 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immunodeficiency virus (SIV), human Immunodeficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994)). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Models of Genetic and Epigenetic Conditions

A method of the invention may be used to create a plant, an animal or cell that may be used to model and/or study genetic or epigenetic conditions of interest, such as a through a model of mutations of interest or a disease model. As used herein, "disease" refers to a disease, disorder, or indication in a subject. For example, a method of the invention may be used to create an animal or cell that comprises a modification in one or more nucleic acid sequences associated with a disease, or a plant, animal or cell in which the expression of one or more nucleic acid sequences associated with a disease are altered. Such a nucleic acid sequence may encode a disease associated protein sequence or may be a disease associated control sequence. Accordingly, it is understood that in embodiments of the invention, a plant, subject, patient, organism or cell can be a non-human subject, patient, organism or cell. Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged.

In some methods, the disease model can be used to study the effects of mutations on the animal or cell and development and/or progression of the disease using measures commonly used in the study of the disease. Alternatively, such a disease model is useful for studying the effect of a pharmaceutically active compound on the disease.

In some methods, the disease model can be used to assess the efficacy of a potential gene therapy strategy. That is, a disease-associated gene or polynucleotide can be modified such that the disease development and/or progression is inhibited or reduced. In particular, the method comprises modifying a disease-associated gene or polynucleotide such that an altered protein is produced and, as a result, the animal or cell has an altered response. Accordingly, in some methods, a genetically modified animal may be compared with an animal predisposed to development of the disease such that the effect of the gene therapy event may be assessed.

In another embodiment, this invention provides a method of developing a biologically active agent that modulates a cell signaling event associated with a disease gene. The method comprises contacting a test compound with a cell comprising one or more vectors that drive expression of one or more of a CRISPR enzyme, and a direct repeat sequence linked to a guide sequence; and detecting a change in a readout that is indicative of a reduction or an augmentation of a cell signaling event associated with, e.g., a mutation in a disease gene contained in the cell.

A cell model or animal model can be constructed in combination with the method of the invention for screening a cellular function change. Such a model may be used to study the effects of a genome sequence modified by the CRISPR complex of the invention on a cellular function of interest. For example, a cellular function model may be used to study the effect of a modified genome sequence on intracellular signaling or extracellular signaling. Alternatively, a cellular function model may be used to study the effects of a modified genome sequence on sensory perception. In some such models, one or more genome sequences associated with a signaling biochemical pathway in the model are modified.

Several disease models have been specifically investigated. These include de novo autism risk genes CHD8, KATNAL2, and SCN2A; and the syndromic autism (Angelman Syndrome) gene UBE3A. These genes and resulting autism models are of course preferred, but serve to show the broad applicability of the invention across genes and corresponding models.

An altered expression of one or more genome sequences associated with a signalling biochemical pathway can be determined by assaying for a difference in the mRNA levels of the corresponding genes between the test model cell and a control cell, when they are contacted with a candidate agent. Alternatively, the differential expression of the sequences associated with a signaling biochemical pathway is determined by detecting a difference in the level of the encoded polypeptide or gene product.

To assay for an agent-induced alteration in the level of mRNA transcripts or corresponding polynucleotides, nucleic acid contained in a sample is first extracted according to standard methods in the art. For instance, mRNA can be isolated using various lytic enzymes or chemical solutions according to the procedures set forth in Sambrook et al. (1989), or extracted by nucleic-acid-binding resins following the accompanying instructions provided by the manufacturers. The mRNA contained in the extracted nucleic acid sample is then detected by amplification procedures or conventional hybridization assays (e.g. Northern blot analysis) according to methods widely known in the art or based on the methods exemplified herein.

For purpose of this invention, amplification means any method employing a primer and a polymerase capable of replicating a target sequence with reasonable fidelity. Amplification may be carried out by natural or recombinant DNA polymerases such as AmpliTaq Gold™, T7 DNA polymerase, Klenow fragment of *E. coli* DNA polymerase, and reverse transcriptase. A preferred amplification method is PCR. In particular, the isolated RNA can be subjected to a reverse transcription assay that is coupled with a quantitative polymerase chain reaction (RT-PCR) in order to quantify the expression level of a sequence associated with a signaling biochemical pathway.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules is typically proportional to the amount of the amplified DNA products, one can conveniently determine the amount of the amplified products by quantifying the fluorescence of the intercalated dye using conventional optical systems in the art. DNA-binding dye suitable for this application include SYBR green, SYBR blue, DAPI, propidium iodine, Oeste, SYBR gold, ethidium bromide, acridines, proflavine, acridine orange, acriflavine, fluorocoumarin, ellipticine, daunomycin, chloroquine, distamycin D, chromomycin, homidium, mithramycin, ruthenium polypyridyls, anthramycin, and the like.

In another aspect, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan® probes) resulting in increased specificity and sensitivity. Methods for performing probe-based quantitative amplification are well established in the art and are taught in U.S. Pat. No. 5,210,015.

In yet another aspect, conventional hybridization assays using hybridization probes that share sequence homology with sequences associated with a signaling biochemical pathway can be performed. Typically, probes are allowed to form stable complexes with the sequences associated with a signaling biochemical pathway contained within the biological sample derived from the test subject in a hybridization reaction. It will be appreciated by one of skill in the art that where antisense is used as the probe nucleic acid, the target polynucleotides provided in the sample are chosen to be complementary to sequences of the antisense nucleic acids. Conversely, where the nucleotide probe is a sense nucleic acid, the target polynucleotide is selected to be complementary to sequences of the sense nucleic acid.

Hybridization can be performed under conditions of various stringency. Suitable hybridization conditions for the practice of the present invention are such that the recognition interaction between the probe and sequences associated with a signaling biochemical pathway is both sufficiently specific and sufficiently stable. Conditions that increase the stringency of a hybridization reaction are widely known and published in the art. See, for example, (Sambrook, et al., (1989); Nonradioactive In Situ Hybridization Application Manual, Boehringer Mannheim, second edition). The hybridization assay can be formed using probes immobilized on any solid support, including but not limited to nitrocellulose, glass, silicon, and a variety of gene arrays. A preferred hybridization assay is conducted on high-density gene chips as described in U.S. Pat. No. 5,445,934.

For a convenient detection of the probe-target complexes formed during the hybridization assay, the nucleotide probes are conjugated to a detectable label. Detectable labels suitable for use in the present invention include any composition detectable by photochemical, biochemical, spectroscopic, immunochemical, electrical, optical or chemical means. A wide variety of appropriate detectable labels are known in the art, which include fluorescent or chemiluminescent labels, radioactive isotope labels, enzymatic or other ligands. In preferred embodiments, one will likely desire to employ a fluorescent label or an enzyme tag, such as digoxigenin, B-galactosidase, urease, alkaline phosphatase or peroxidase, avidin/biotin complex.

The detection methods used to detect or quantify the hybridization intensity will typically depend upon the label selected above. For example, radiolabels may be detected using photographic film or a phosphoimager. Fluorescent markers may be detected and quantified using a photodetector to detect emitted light. Enzymatic labels are typically detected by providing the enzyme with a substrate and measuring the reaction product produced by the action of the enzyme on the substrate; and finally colorimetric labels are detected by simply visualizing the colored label.

An agent-induced change in expression of sequences associated with a signaling biochemical pathway can also be determined by examining the corresponding gene products. Determining the protein level typically involves (a) contacting the protein contained in a biological sample with an agent that specifically bind to a protein associated with a signaling biochemical pathway; and (b) identifying any agent:protein complex so formed. In one aspect of this embodiment, the agent that specifically binds a protein associated with a signaling biochemical pathway is an antibody, preferably a monoclonal antibody.

The reaction is performed by contacting the agent with a sample of the proteins associated with a signaling biochemical pathway derived from the test samples under conditions that will allow a complex to form between the agent and the proteins associated with a signaling biochemical pathway. The formation of the complex can be detected directly or indirectly according to standard procedures in the art. In the direct detection method, the agents are supplied with a detectable label and unreacted agents may be removed from the complex; the amount of remaining label thereby indicating the amount of complex formed. For such method, it is preferable to select labels that remain attached to the agents even during stringent washing conditions. It is preferable that the label does not interfere with the binding reaction. In the alternative, an indirect detection procedure may use an agent that contains a label introduced either chemically or enzymatically. A desirable label generally does not interfere with binding or the stability of the resulting agent:polypeptide complex. However, the label is typically designed to be accessible to an antibody for an effective binding and hence generating a detectable signal.

A wide variety of labels suitable for detecting protein levels are known in the art. Non-limiting examples include radioisotopes, enzymes, colloidal metals, fluorescent compounds, bioluminescent compounds, and chemiluminescent compounds.

The amount of agent:polypeptide complexes formed during the binding reaction can be quantified by standard quantitative assays. As illustrated above, the formation of agent:polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

A number of techniques for protein analysis based on the general principles outlined above are available in the art. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SDS-PAGE.

Antibodies that specifically recognize or bind to proteins associated with a signaling biochemical pathway are preferable for conducting the aforementioned protein analyses. Where desired, antibodies that recognize a specific type of post-translational modifications (e.g., signaling biochemical pathway inducible modifications) can be used. Post-translational modifications include but are not limited to glycosylation, lipidation, acetylation, and phosphorylation. These antibodies may be purchased from commercial vendors. For example, anti-phosphotyrosine antibodies that specifically recognize tyrosine-phosphorylated proteins are available from a number of vendors including Invitrogen and Perkin Elmer. Anti-phosphotyrosine antibodies are particularly useful in detecting proteins that are differentially phosphorylated on their tyrosine residues in response to an ER stress. Such proteins include but are not limited to eukaryotic translation initiation factor 2 alpha (eIF-2α). Alternatively, these antibodies can be generated using conventional polyclonal or monoclonal antibody technologies by immunizing a host animal or an antibody-producing cell with a target protein that exhibits the desired post-translational modification.

In practicing the subject method, it may be desirable to discern the expression pattern of an protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

An altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays such as AlphaScreen™ (available from Perkin Elmer) and eTag™ assay (Chan-Hui, et al. (2003) Clinical Immunology 111: 162-174).

Where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are particularly suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a minisecond.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA).

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Without wishing to be bound by theory, it is believed that the target sequence should be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence) Examples of PAM sequences are given in the examples section below, and the skilled person will be able to identify further PAM sequences for use with a given CRISPR enzyme.

The target polynucleotide of a CRISPR complex may include a number of disease associated genes and polynucleotides as well as signaling biochemical pathway-associated genes and polynucleotides as listed in U.S. provisional patent applications 61/736,527 and 61/748,427 both entitled SYSTEMS METHODS AND COMPOSITIONS FOR SEQUENCE MANIPULATION filed on Dec. 12, 2012 and Jan. 2, 2013, respectively, and PCT Application PCT/US2013/074667, entitled DELIVERY, ENGINEERING AND OPTIMIZATION OF SYSTEMS, METHODS AND COMPOSITIONS FOR SEQUENCE MANIPULATION AND THERAPEUTIC APPLICATIONS, filed Dec. 12, 2013, the contents of all of which are herein incorporated by reference in their entirety.

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

Transcriptome Wide Knock-down Screening

The CRISPR effector protein complexes described herein can be used to perform efficient and cost effective functional transcriptomic screens. Such screens can utilize CRISPR effector protein based transcriptome wide libraries. Such screens and libraries can provide for determining the function of genes, cellular pathways genes are involved in, and how any alteration in gene expression can result in a particular biological process. An advantage of the present invention is that the CRISPR system avoids off-target binding and its resulting side effects. This is achieved using systems arranged to have a high degree of sequence specificity for the target DNA. In preferred embodiments of the invention, the CRISPR effector protein complexes are C2c2 effector protein complexes.

In embodiments of the invention, a transcriptome wide library may comprise a plurality of C2c2 guide RNAs, as described herein, comprising guide sequences that are capable of targeting a plurality of target sequences in a plurality of loci in a population of eukaryotic cells. The population of cells may be a population of embryonic stem (ES) cells. The target sequence in the locus may be a non-coding sequence. The non-coding sequence may be an intron, regulatory sequence, splice site, 3' UTR, 5' UTR, or polyadenylation signal. Gene function of one or more gene products may be altered by said targeting. The targeting may result in a knockout of gene function. The targeting of a gene product may comprise more than one guide RNA. A gene product may be targeted by 2, 3, 4, 5, 6, 7, 8, 9, or 10 guide RNAs, preferably 3 to 4 per gene. Off-target modifications may be minimized by exploiting the staggered double strand breaks generated by C2c2 effector protein complexes or by utilizing methods analogous to those used in CRISPR-Cas9 systems (See, e.g., DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013)), incorporated herein by reference. The targeting may be of about 100 or more sequences. The targeting may be of about 1000 or more sequences. The targeting may be of about 20,000 or more sequences. The targeting may be of the entire genome. The targeting may be of a panel of target sequences focused on a relevant or desirable pathway. The pathway may be an immune pathway. The pathway may be a cell division pathway.

One aspect of the invention comprehends a transcriptome wide library that may comprise a plurality of C2c2 guide RNAs that may comprise guide sequences that are capable of targeting a plurality of target sequences in a plurality of loci, wherein said targeting results in a knockdown of gene function. This library may potentially comprise guide RNAs that target each and every gene in the genome of an organism.

In some embodiments of the invention the organism or subject is a eukaryote (including mammal including human) or a non-human eukaryote or a non-human animal or a non-human mammal. In some embodiments, the organism or subject is a non-human animal, and may be an arthropod, for example, an insect, or may be a nematode. In some methods of the invention the organism or subject is a plant. In some methods of the invention the organism or subject is a mammal or a non-human mammal. A non-human mammal may be for example a rodent (preferably a mouse or a rat), an ungulate, or a primate. In some methods of the invention the organism or subject is algae, including microalgae, or is a fungus.

The knockdown of gene function may comprise: introducing into each cell in the population of cells a vector system of one or more vectors comprising an engineered, non-naturally occurring C2c2 effector protein system comprising I. a C2c2 effector protein, and II. one or more guide RNAs, wherein components I and II may be same or on different vectors of the system, integrating components I and II into each cell, wherein the guide sequence targets a unique gene in each cell, wherein the C2c2 effector protein is operably linked to a regulatory element, wherein when transcribed, the guide RNA comprising the guide sequence directs sequence-specific binding of the C2c2 effector protein system to a target sequence in the genomic loci of the unique gene, inducing cleavage of the genomic loci by the C2c2 effector protein, and confirming different knockdown events in a plurality of unique genes in each cell of the population of cells thereby generating a gene knockdown cell library. The invention comprehends that the population of cells is a population of eukaryotic cells, and in a preferred embodiment, the population of cells is a population of embryonic stem (ES) cells.

The one or more vectors may be plasmid vectors. The vector may be a single vector comprising a C2c2 effector protein, a sgRNA, and optionally, a selection marker into target cells. Not being bound by a theory, the ability to simultaneously deliver a C2c2 effector protein and sgRNA through a single vector enables application to any cell type of interest, without the need to first generate cell lines that express the C2c2 effector protein. The regulatory element may be an inducible promoter. The inducible promoter may be a doxycycline inducible promoter. In some methods of the invention the expression of the guide sequence is under the control of the T7 promoter and is driven by the expression of T7 polymerase. The confirming of different knockdown events may be by whole transcriptome sequencing. The knockdown event may be achieved in 100 or more unique genes. The knockdown event may be achieved in 1000 or more unique genes. The knockdown event may be achieved in 20,000 or more unique genes. The knockdown event may be achieved in the entire transcriptome. The knockdown of gene function may be achieved in a plurality of unique genes which function in a particular physiological pathway or condition. The pathway or condition may be an immune pathway or condition. The pathway or condition may be a cell division pathway or condition.

The invention also provides kits that comprise the transcriptome wide libraries mentioned herein. The kit may comprise a single container comprising vectors or plasmids comprising the library of the invention. The kit may also comprise a panel comprising a selection of unique C2c2 effector protein system guide RNAs comprising guide sequences from the library of the invention, wherein the selection is indicative of a particular physiological condition. The invention comprehends that the targeting is of about 100 or more sequences, about 1000 or more sequences or about 20,000 or more sequences or the entire transcriptome. Furthermore, a panel of target sequences may be focused on a relevant or desirable pathway, such as an immune pathway or cell division.

In an additional aspect of the invention, the C2c2 effector protein may comprise one or more mutations and may be used as a generic RNA binding protein with or without fusion to a functional domain. The mutations may be artificially introduced mutations or gain- or loss-of-function mutations. The mutations have been characterized as described herein. In one aspect of the invention, the functional domain may be a transcriptional activation domain, which may be VP64. In other aspects of the invention, the functional domain may be a transcriptional repressor domain, which may be KRAB or SID4X. Other aspects of the invention relate to the mutated C2c2 effector protein being fused to domains which include but are not limited to a transcriptional activator, repressor, a recombinase, a transposase, a histone remodeler, a demethylase, a DNA methyltransferase, a cryptochrome, a light inducible/controllable domain or a chemically inducible/controllable domain. Some methods of the invention can include inducing expression of targeted genes. In one embodiment, inducing expression by targeting a plurality of target sequences in a plurality of genomic loci in a population of eukaryotic cells is by use of a functional domain.

Useful in the practice of the instant invention utilizing C2c2 effector protein complexes are methods used in CRISPR-Cas9 systems and reference is made to:

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print]; Published in final edited form as: Science. 2014 Jan. 3; 343(6166): 84-87.

Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Reference is also made to US patent publication number US20140357530; and PCT Patent Publication WO2014093701, hereby incorporated herein by reference.

Functional Alteration and Screening

In another aspect, the present invention provides for a method of functional evaluation and screening of genes. The use of the CRISPR system of the present invention to precisely deliver functional domains, to activate or repress genes or to alter epigenetic state by precisely altering the methylation site on a specific locus of interest, can be with one or more guide RNAs applied to a single cell or population of cells or with a library applied to genome in a pool of cells ex vivo or in vivo comprising the administration or expression of a library comprising a plurality of guide RNAs (sgRNAs) and wherein the screening further comprises use of a C2c2 effector protein, wherein the CRISPR complex comprising the C2c2 effector protein is modified to comprise a heterologous functional domain. In an aspect the invention provides a method for screening a genome/transcriptome comprising the administration to a host or expression in a host in vivo of a library. In an aspect the invention provides a method as herein discussed further comprising an activator administered to the host or expressed in the host. In an aspect the invention provides a method as herein discussed wherein the activator is attached to a C2c2 effector protein. In an aspect the invention provides a method as herein discussed wherein the activator is attached to the N terminus or the C terminus of the C2c2 effector protein. In an aspect the invention provides a method as herein discussed wherein the activator is attached to a sgRNA loop. In an aspect the invention provides a method as herein discussed further comprising a repressor administered to the host or expressed in the host. In an aspect the invention provides a method as herein discussed, wherein the screening comprises affecting and detecting gene activation, gene inhibition, or cleavage in the locus.

In an aspect, the invention provides efficient on-target activity and minimizes off target activity. In an aspect, the invention provides efficient on-target cleavage by C2c2 effector protein and minimizes off-target cleavage by the C2c2 effector protein. In an aspect, the invention provides guide specific binding of C2c2 effector protein at a gene locus without DNA cleavage. Accordingly, in an aspect, the invention provides target-specific gene regulation. In an aspect, the invention provides guide specific binding of C2c2 effector protein at a gene locus without DNA cleavage. Accordingly, in an aspect, the invention provides for cleavage at one locus and gene regulation at a different locus using a single C2c2 effector protein. In an aspect, the invention provides orthogonal activation and/or inhibition and/or cleavage of multiple targets using one or more C2c2 effector protein and/or enzyme.

In an aspect the invention provides a method as herein discussed, wherein the host is a eukaryotic cell. In an aspect the invention provides a method as herein discussed, wherein the host is a mammalian cell. In an aspect the invention provides a method as herein discussed, wherein the host is a non-human eukaryote. In an aspect the invention provides a method as herein discussed, wherein the non-human eukaryote is a non-human mammal. In an aspect the invention provides a method as herein discussed, wherein the non-human mammal is a mouse. An aspect the invention provides a method as herein discussed comprising the delivery of the C2c2 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein discussed wherein the expressing in vivo is via a lentivirus, an adenovirus, or an AAV. In an aspect the invention provides a method as herein discussed wherein the delivery is via a particle, a nanoparticle, a lipid or a cell penetrating peptide (CPP).

In an aspect the invention provides a pair of CRISPR complexes comprising C2c2 effector protein, each comprising a guide RNA (sgRNA) comprising a guide sequence capable of hybridizing to a target sequence in a genomic locus of interest in a cell, wherein at least one loop of each sgRNA is modified by the insertion of distinct RNA sequence(s) that bind to one or more adaptor proteins, and wherein the adaptor protein is associated with one or more functional domains, wherein each sgRNA of each C2c2 effector protein complex comprises a functional domain having a DNA cleavage activity.

In an aspect the invention provides a method for cutting a target sequence in a locus of interest comprising delivery to a cell of the C2c2 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein-discussed wherein the delivery is via a lentivirus, an adenovirus, or an AAV.

In an aspect the invention provides a library, method or complex as herein-discussed wherein the sgRNA is modified to have at least one non-coding functional loop, e.g., wherein the at least one non-coding functional loop is repressive; for instance, wherein the at least one non-coding functional loop comprises Alu.

In one aspect, the invention provides a method for altering or modifying expression of a gene product. The said method may comprise introducing into a cell containing and expressing a DNA molecule encoding the gene product an engineered, non-naturally occurring CRISPR system comprising a C2c2 effector protein and guide RNA that targets the RNA molecule, whereby the guide RNA targets the RNA target molecule encoding the gene product and the C2c2 effector protein cleaves the RNA molecule encoding the gene product, whereby expression of the gene product is altered; and, wherein the C2c2 effector protein and the guide RNA do not naturally occur together. The invention comprehends the guide RNA comprising a guide sequence linked to a direct repeat sequence. The invention further comprehends the C2c2 effector protein being codon optimized for expression in a Eukaryotic cell. In a preferred embodiment the Eukaryotic cell is a mammalian cell and in a more preferred embodiment the mammalian cell is a human cell. In a further embodiment of the invention, the expression of the gene product is decreased.

In some embodiments, one or more functional domains are associated with the C2c2 effector protein. In some embodiments, one or more functional domains are associated with an adaptor protein, for example as used with the modified guides of Konnerman et al. (Nature 517, 583-588, 29 Jan. 2015). In some embodiments, one or more functional domains are associated with an dead sgRNA (dRNA). In some embodiments, a dRNA complex with active C2c2 effector protein directs gene regulation by a functional domain at on gene locus while an sgRNA directs DNA cleavage by the active C2c2 effector protein at another locus, for example as described analogously in CRISPR-Cas9 systems by Dahlman et al., 'Orthogonal gene control with a catalytically active Cas9 nuclease,' Nature Biotechnology 33, p. 1159-61 (November, 2015). In some embodiments, dRNAs are selected to maximize selectivity of regulation for a gene locus of interest compared to off-target regulation. In some embodiments, dRNAs are selected to maximize target gene regulation and minimize target cleavage.

For the purposes of the following discussion, reference to a functional domain could be a functional domain associated with the C2c2 effector protein or a functional domain associated with the adaptor protein.

In some embodiments, the one or more functional domains is an NLS (Nuclear Localization Sequence) or an NES (Nuclear Export Signal). In some embodiments, the one or more functional domains is a transcriptional activation domain comprises VP64, p65, MyoD1, HSF1, RTA, SET7/9 and a histone acetyltransferase. Other references herein to activation (or activator) domains in respect of those associated with the CRISPR enzyme include any known transcriptional activation domain and specifically VP64, p65, MyoD1, HSF1, RTA, SET7/9 or a histone acetyltransferase.

In some embodiments, the one or more functional domains is a transcriptional repressor domain. In some embodiments, the transcriptional repressor domain is a KRAB domain. In some embodiments, the transcriptional repressor domain is a NUE domain, NcoR domain, SID domain or a SID4X domain.

In some embodiments, the one or more functional domains have one or more activities comprising translation activation activity, translation repression activity, methylase activity, demethylase activity, transcription activation activity, transcription repression activity, transcription release factor activity, histone modification activity, RNA cleavage activity, DNA cleavage activity, DNA integration activity or nucleic acid binding activity.

Histone modifying domains are also preferred in some embodiments. Exemplary histone modifying domains are discussed below. Transposase domains, HR (Homologous Recombination) machinery domains, recombinase domains, and/or integrase domains are also preferred as the present functional domains. In some embodiments, DNA integration activity includes HR machinery domains, integrase domains, recombinase domains and/or transposase domains. Histone acetyltransferases are preferred in some embodiments.

In some embodiments, the DNA cleavage activity is due to a nuclease. In some embodiments, the nuclease comprises a Fok1 nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In some embodiments, the one or more functional domains is attached to the C2c2 effector protein so that upon binding to the sgRNA and target the functional domain is in a spatial orientation allowing for the functional domain to function in its attributed function.

In some embodiments, the one or more functional domains is attached to the adaptor protein so that upon binding of the C2c2 effector protein to the sgRNA and target, the functional domain is in a spatial orientation allowing for the functional domain to function in its attributed function.

In an aspect the invention provides a composition as herein discussed wherein the one or more functional domains is attached to the C2c2 effector protein or adaptor protein via a linker, optionally a Gly-Ser linker, as discussed herein.

It is also preferred to target endogenous (regulatory) control elements, such as involved in translation, stability, etc. Targeting of known control elements can be used to activate or repress the gene of interest. Targeting of putative control elements on the other hand can be used as a means to verify such elements (by measuring the translation of the gene of interest) or to detect novel control elements. In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNA-seq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence. Epigenomic target sequence may include, in some embodiments, include a promoter, silencer or an enhancer sequence.

Use of a functional domain linked to a C2c2 effector protein as described herein, preferably a dead-C2c2 effector protein, more preferably a dead-FnC2c2 effector protein, to target epigenomic sequences can be used to activate or repress promoters, silencer or enhancers.

Examples of acetyltransferases are known but may include, in some embodiments, histone acetyltransferases. In some embodiments, the histone acetyltransferase may comprise the catalytic core of the human acetyltransferase p300 (Gerbasch & Reddy, Nature Biotech 6th April 2015).

In some preferred embodiments, the functional domain is linked to a dead-C2c2 effector protein to target and activate epigenomic sequences such as promoters or enhancers. One or more guides directed to such promoters or enhancers may also be provided to direct the binding of the CRISPR enzyme to such promoters or enhancers.

In certain embodiments, the RNA targeting effector protein of the invention can be used to interfere with co-transcriptional modifications of DNA/chromatin structure, RNA-directed DNA methylation, or RNA-directed silencing/activation of DNA/chromatin. RNA-directed DNA methylation (RdDM) is an epigenetic process first discovered in plants. During RdDM, double-stranded RNAs (dsRNAs) are processed to 21-24 nucleotide small interfering RNAs (siRNAs) and guide methylation of homologous DNA loci. Besides RNA molecules, a plethora of proteins are involved in the establishment of RdDM, like Argonautes, DNA methyltransferases, chromatin remodelling complexes and the plant-specific PolIV and PolV. All these act in concert to add a methyl-group at the 5' position of cytosines. Small RNAs can modify the chromatin structure and silence transcription by guiding Argonaute-containing complexes to complementary nascent (non-coding) RNA transcripts. Subsequently the recruitment of chromatin-modifying complexes, including histone and DNA methyltransferases, is mediated. The RNA targeting effector protein of the invention may be used to target such small RNAs and interfere in interactions between these small RNAs and the nascent non-coding transcripts.

The term "associated with" is used here in relation to the association of the functional domain to the C2c2 effector protein or the adaptor protein. It is used in respect of how one molecule 'associates' with respect to another, for example between an adaptor protein and a functional domain, or between the C2c2 effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the C2c2 effector protein or adaptor protein is associated with a functional domain by binding thereto. In other embodiments, the C2c2 effector protein or adaptor protein is associated with a functional domain because the two are fused together, optionally via an intermediate linker.

Saturating Mutagenesis

The C2c2 effector protein system(s) described herein can be used to perform saturating or deep scanning mutagenesis of genomic loci in conjunction with a cellular phenotype—for instance, for determining critical minimal features and discrete vulnerabilities of functional elements required for gene expression, drug resistance, and reversal of disease. By saturating or deep scanning mutagenesis is meant that every or essentially every RNA base is cut within the genomic loci. A library of C2c2 effector protein guide RNAs may be introduced into a population of cells. The library may be introduced, such that each cell receives a single guide RNA (sgRNA). In the case where the library is introduced by transduction of a viral vector, as described herein, a low multiplicity of infection (MOI) is used. The library may include sgRNAs targeting every sequence upstream of a (protospacer adjacent motif) (PAM) sequence in a genomic locus. The library may include at least 100 non-overlapping genomic sequences upstream of a PAM sequence for every 1000 base pairs within the genomic locus. The library may include sgRNAs targeting sequences upstream of at least one different PAM sequence. The C2c2 effector protein systems may include more than one C2c2 protein. Any C2c2 effector protein as described herein, including orthologues or engineered C2c2 effector proteins that recognize different PAM sequences may be used. The frequency of off target sites for a sgRNA may be less than 500. Off target scores may be generated to select sgRNAs with the lowest off target sites. Any phenotype determined to be associated with cutting at a sgRNA target site may be confirmed by using sgRNAs targeting the same site in a single experiment. Validation of a target site may also be performed by using a modified C2c2 effector protein, as described herein, and two sgRNAs targeting the genomic site of interest. Not being bound by a theory, a target site is a true hit if the change in phenotype is observed in validation experiments.

The C2c2 effector protein system(s) for saturating or deep scanning mutagenesis can be used in a population of cells. The C2c2 effector protein system(s) can be used in eukaryotic cells, including but not limited to mammalian and plant cells. The population of cells may be prokaryotic cells. The population of eukaryotic cells may be a population of embryonic stem (ES) cells, neuronal cells, epithelial cells, immune cells, endocrine cells, muscle cells, erythrocytes, lymphocytes, plant cells, or yeast cells.

In one aspect, the present invention provides for a method of screening for functional elements associated with a change in a phenotype. The library may be introduced into a population of cells that are adapted to contain a C2c2 effector protein. The cells may be sorted into at least two groups based on the phenotype. The phenotype may be expression of a gene, cell growth, or cell viability. The relative representation of the guide RNAs present in each group are determined, whereby genomic sites associated with the change in phenotype are determined by the representation of guide RNAs present in each group. The change in phenotype may be a change in expression of a gene of interest. The gene of interest may be upregulated, downregulated, or knocked out. The cells may be sorted into a high expression group and a low expression group. The population of cells may include a reporter construct that is used to determine the phenotype. The reporter construct may include a detectable marker. Cells may be sorted by use of the detectable marker.

In another aspect, the present invention provides for a method of screening for loci associated with resistance to a chemical compound. The chemical compound may be a drug or pesticide. The library may be introduced into a population of cells that are adapted to contain a C2c2 effector protein, wherein each cell of the population contains no more than one guide RNA; the population of cells are treated with the chemical compound; and the representation of guide RNAs are determined after treatment with the chemical compound at a later time point as compared to an early time point, whereby genomic sites associated with resistance to the chemical compound are determined by enrichment of guide RNAs. Representation of sgRNAs may be determined by deep sequencing methods.

Useful in the practice of the instant invention utilizing C2c2 effector protein complexes are methods used in CRISPR-Cas9 systems and reference is made to the article entitled BCL11A enhancer dissection by Cas9-mediated in situ saturating mutagenesis. Canver, M. C., Smith, E. C., Sher, F., Pinello, L., Sanjana, N. E., Shalem, O., Chen, D. D., Schupp, P. G., Vinjamur, D. S., Garcia, S. P., Luc, S., Kurita, R., Nakamura, Y., Fujiwara, Y., Maeda, T., Yuan, G., Zhang, F., Orkin, S. H., & Bauer, D. E. DOI:10.1038/nature15521, published online Sep. 16, 2015, the article is herein incorporated by reference and discussed briefly below:

Canver et al. involves novel pooled CRISPR-Cas9 guide RNA libraries to perform in situ saturating mutagenesis of the human and mouse BCL11A erythroid enhancers previously identified as an enhancer associated with fetal hemoglobin (HbF) level and whose mouse ortholog is necessary for erythroid BCL11A expression. This approach revealed critical minimal features and discrete vulnerabilities of these enhancers. Through editing of primary human progenitors and mouse transgenesis, the authors validated the BCL11A erythroid enhancer as a target for HbF reinduction. The authors generated a detailed enhancer map that informs therapeutic genome editing.

Method of Using C2c2 Systems to Modify a Cell or Organism

The invention in some embodiments comprehends a method of modifying a cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The system may comprise one or more different vectors. In an aspect of the invention, the effector protein is codon optimized for expression the desired cell type, preferentially a eukaryotic cell, preferably a mammalian cell or a human cell.

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr –/–, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalclc7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a nucleic acid-targeting system as described herein (such as by transient transfection of one or more vectors, or transfection with RNA), and modified through the activity of a nucleic acid-targeting complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is a mammal, such as a mouse, rat, or rabbit. In certain embodiments, the organism or subject is a plant. In certain embodiments, the organism or subject or plant is algae. Methods for producing transgenic plants and animals are known in the art, and generally begin with a method of cell transfection, such as described herein.

In one aspect, the invention provides for methods of modifying a target polynucleotide in a eukaryotic cell. In some embodiments, the method comprises allowing a nucleic acid-targeting complex to bind to the target polynucleotide to effect cleavage of said target polynucleotide thereby modifying the target polynucleotide, wherein the nucleic acid-targeting complex comprises a nucleic acid-targeting effector protein complexed with a guide RNA hybridized to a target sequence within said target polynucleotide.

In one aspect, the invention provides a method of modifying expression of a polynucleotide in a eukaryotic cell. In some embodiments, the method comprises allowing a nucleic acid-targeting complex to bind to the polynucleotide such that said binding results in increased or decreased expression of said polynucleotide; wherein the nucleic acid-targeting complex comprises a nucleic acid-targeting effector protein complexed with a guide RNA hybridized to a target sequence within said polynucleotide.

C2c2 Effector Protein Complexes can be Used in Plants

The C2c2 effector protein system(s) (e.g., single or multiplexed) can be used in conjunction with recent advances in crop genomics. The systems described herein can be used to perform efficient and cost effective plant gene or genome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The C2c2 effector protein system(s) can be used with regard to plants in Site-Directed Integration (SDI) or Gene Editing (GE) or any Near Reverse Breeding (NRB) or Reverse Breeding (RB) techniques. Aspects of utilizing the herein described C2c2 effector protein systems may be analogous to the use of the CRISPR-Cas (e.g. CRISPR-Cas9) system in plants, and mention is made of the University of Arizona website "CRISPR-PLANT" (http://www.genome.arizona.edu/crispr/) (supported by Penn State and AGI). Embodiments of the invention can be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi:10.1186/1746-4811-9-39); Brooks, "Efficient gene editing in tomato in the first generation using the CRISPR-Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi:10.1038/cr.2013.114; published online 20 Aug. 2013; Xie, "RNA-guided genome editing in plants using a CRISPR-Cas system," Mol Plant. 2013 November; 6(6):1975-83. doi: 10.1093/mp/sst119. Epub 2013 Aug. 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial *Populus* reveals 4-coumarate: CoA ligase specificity and Redundancy," New Phytologist (2015) (Forum) 1-4 (available online only at www.newphytologist.com); Caliando et al., "Targeted DNA degradation using a CRISPR device stably carried in the host genome, NATURE COMMUNICATIONS 6:6989, DOI: 10.1038/ncomms7989, www.nature.com/naturecommunications DOI: 10.1038/ncomms7989; U.S. Pat. No. 6,603,061 —*Agrobacterium*-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al. "Crop genomics: advances and applications," Nat Rev Genet. 2011 Dec. 29; 13(2):85-96; each of which is incorporated by reference herein including as to how herein embodiments may be used as to plants. Accordingly, reference herein to animal cells may also apply, mutatis mutandis, to plant cells unless otherwise apparent;

and, the enzymes herein having reduced off-target effects and systems employing such enzymes can be used in plant applications, including those mentioned herein.

Sugano et al. (Plant Cell Physiol. 2014 March; 55(3):475-81. doi: 10.1093/pcp/pcu014. Epub 2014 Jan. 18) reports the application of CRISPR-Cas9 to targeted mutagenesis in the liverwort *Marchantia polymorpha* L., which has emerged as a model species for studying land plant evolution. The U6 promoter of *M. polymorpha* was identified and cloned to express the gRNA. The target sequence of the gRNA was designed to disrupt the gene encoding auxin response factor 1 (ARF1) in *M. polymorpha*. Using *Agrobacterium*-mediated transformation, Sugano et al. isolated stable mutants in the gametophyte generation of *M. polymorpha*. CRISPR/Cas9-based site-directed mutagenesis in vivo was achieved using either the Cauliflower mosaic virus 35S or *M. polymorpha* EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR/Cas9-based targeted mutagenesis. The C2c2 systems of the present invention can be used to regulate the same as well as other genes, and like expression control systems such as RNAi and siRNA, the method of the invention can be inducible and reversible.

Kabadi et al. (Nucleic Acids Res. 2014 Oct. 29; 42(19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The instant invention can be used to regulate the plant genes of Kabadi.

Xing et al. (BMC Plant Biology 2014, 14:327) developed a CRISPR-Cas9 binary vector set based on the pGreen or pCAMBIA backbone, as well as a gRNA. This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation. (guide RNA)module vector set, as a toolkit for multiplex genome editing in plants. The C2c2 systems and proteins of the instant invention may be used to target the genes targeted by Xing.

The C2c2 CRISPR systems of the invention may be used in the detection of plant viruses. Gambino et al. (Phytopathology. 2006 November; 96(11):1223-9. doi: 10.1094/PHYTO-96-1223) relied on amplification and multiplex PCR for simultaneous detection of nine grapevine viruses. The C2c2 systems and proteins of the instant invention may similarly be used to detect multiple targets in a host. Moreover, the systems of the invention can be used to simultaneously knock down viral gene expression in valuable cultivars, and prevent activation or further infection by targeting expressed viral RNA.

Murray et al. (Proc Biol Sci. 2013 Jun. 26; 280(1765): 20130965. doi: 10.1098/rspb.2013.0965; published 2013 Aug. 22) analyzed 12 plant RNA viruses to investigate evolutionary rates and found evidence of episodic selection possibly due to shifts between different host genotypes or species. The C2c2 systems and proteins of the instant invention may be used to target or immunize against such viruses in a host. For example, the systems of the invention can be used to block viral RNA expression hence replication. Also, the invention can be used to target nucleic acids for cleavage as well as to target expression or activation. Moreover, the systems of the invention can be multiplexed so as to hit multiple targets or multiple isolate of the same virus.

Ma et al. (Mol Plant. 2015 Aug. 3; 8(8):1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in TO rice and T1 *Arabidopsis* plants by simultaneous targeting of multiple (up to eight) members of a gene family, multiple genes in a biosynthetic pathway, or multiple sites in a single gene. Similarly, the C2c2 systems of the instant invention can dffieicnelty target expression of multiple genes simultaneously.

Lowder et al. (Plant Physiol. 2015 Aug. 21. pii: pp. 00636.2015) also developed a CRISPR-Cas9 toolbox enables multiplex genome editing and transcriptional regulation of expressed, silenced or non-coding genes in plants. This toolbox provides researchers with a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modern plant biotechnology, genetics, molecular biology and physiology. As such, we developed a method for the assembly of Cas9 (WT, nickase or dCas9) and gRNA(s) into a T-DNA destination-vector of interest. The assembly method is based on both Golden Gate assembly and MultiSite Gateway recombination. Three modules are required for assembly. The first module is a Cas9 entry vector, which contains promoterless Cas9 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas9 expression. The toolbox of Lowder et al. may be applied to the C2c2 effector protein system of the present invention.

Organisms such as yeast and microalgae are widely used for synthetic biology. Stovicek et al. (Metab. Eng. Comm., 2015; 2:13) describes genome editing of industrial yeast, for example, *Saccharomyces cerevisiae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2μ based vector locations. The authors also showed that gene disruption efficiency could be improved by optimization of the levels of Cas9 and gRNA expression. Hlavová et al. (Biotechnol. Adv. 2015) discusses development of species or strains of microalgae using techniques such as CRISPR to target nuclear and chloroplast genes for insertional mutagenesis and screening. The same plasmids and vectors can be applied to the C2c2 systems of the instant invention.

Petersen ("Towards precisely glycol engineered plants," Plant Biotech Denmark Annual meeting 2015, Copenhagen, Denmark) developed a method of using CRISPR/Cas9 to engineer genome changes in *Arabidopsis*, for example to applied *Arabidopsis* for production of proteins and products having desired posttranslational modifications. Hebelstrup et al. (Front Plant Sci. 2015 Apr. 23; 6:247) outlines in planta starch bioengineering, providing crops that express starch modifying enzymes and directly produce products that normally are made by industrial chemical and/or physical treatments of starches. The methods of Petersen and Hebelstrup may be applied to the C2c2 effector protein system of the present invention.

Kurth et al., (J Virol. 2012 June; 86(11):6002-9. Doi: 10.1128/JVI.00436-12. Epub 2012 Mar. 21) developed an RNA virus-based vector for the introduction of desired traits into grapevine without heritable modifications to the genome. The vector provided the ability to regulate expression of endogenous genes by virus-induced gene silencing. The C2c2 systems and proteins of the instant invention can be used to silence genes and proteins without heritable modification to the genome.

In an embodiment, the plant may be a legume. The present invention may utilize the herein disclosed CRISP-Cas system for exploring and modifying, for example, without limitation, soybeans, peas, and peanuts. Curtin et al. provides a toolbox for legume function genomics. (See Curtin et al., "A genome engineering toolbox for legume Functional genomics," International Plant and Animal Genome Conference XXII 2014). Curtin used the genetic transformation of CRISPR to knock-out/down single copy and duplicated legume genes both in hairy root and whole plant systems. Some of the target genes were chosen in order to explore and optimize the features of knock-out/down systems (e.g., phytoene desaturase), while others were identified by soybean homology to *Arabidopsis* Dicer-like genes or by genome-wide association studies of nodulation in *Medicago*. The C2c2 systems and proteins of the instant invention can be used to knockout/knockdown systems.

Peanut allergies and allergies to legumes generally are a real and serious health concern. The C2c2 effector protein system of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. (See, Nicolaou et al., Current Opinion in Allergy and Clinical Immunology 2011; 11(3):222).

In an advantageous embodiment, the plant may be a tree. The present invention may also utilize the herein disclosed CRISPR Cas system for herbaceous systems (see, e.g., Belhaj et al., Plant Methods 9: 39 and Harrison et al., Genes & Development 28: 1859-1872). In a particularly advantageous embodiment, the CRISPR Cas system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a CRISPR Cas system in the woody perennial *Populus* using the 4-coumarate:CoA ligase (4CL) gene family as a case study and achieved 100% mutational efficiency for two 4CL genes targeted, with every transformant examined carrying biallelic modifications. In the Zhou et al., study, the CRISPR-Cas9 system was highly sensitive to single nucleotide polymorphisms (SNPs), as cleavage for a third 4CL gene was abolished due to SNPs in the target sequence. These methods may be applied to the C2c2 effector protein system of the present invention.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR-Cas9 editing. The *Populus tremula×alba* clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformation, the gRNA is expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the C2c2 effector protein system of the present invention.

In plants, pathogens are often host-specific. For example, *Fusarium oxysporum* f. sp. *Lycopersici* causes tomato wilt but attacks only tomato, and *F. oxysporum* f. *dianthi Puccinia graminis* f. sp. *Tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

Aside from the plants otherwise discussed herein and above, engineered plants modified by the effector protein and suitable guide, and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide.

Therapeutic Treatment

The system of the invention can be applied in areas of former RNA cutting technologies, without undue experimentation, from this disclosure, including therapeutic, assay and other applications, because the present application provides the foundation for informed engineering of the system. The present invention provides for therapeutic treatment of a disease caused by overexpression of RNA, toxic RNA and/or mutated RNA (such as, for example, splicing defects or truncations). Expression of the toxic RNA may be associated with formation of nuclear inclusions and late-onset degenerative changes in brain, heart or skeletal muscle. In the best studied example, myotonic dystrophy, It appears that the main pathogenic effect of the toxic RNA is to sequester binding proteins and compromise the regulation of alternative splicing (Hum. Mol. Genet. (2006) 15 (suppl 2): R162-R169). Myotonic dystrophy [dystrophia myotonica (DM)] is of particular interest to geneticists because it produces an extremely wide range of clinical features. A partial listing would include muscle wasting, cataracts, insulin resistance, testicular atrophy, slowing of cardiac conduction, cutaneous tumors and effects on cognition. The classical form of DM, which is now called DM type 1 (DM1), is caused by an expansion of CTG repeats in the 3'-untranslated region (UTR) of DMPK, a gene encoding a cytosolic protein kinase.

The below table presents a list of exons shown to have misregulated alternative splicing in DM1 skeletal muscle, heart or brain.

| Tissue/gene Target Skeletal muscle | | Reference |
| --- | --- | --- |
| ALP | ex 5a, 5b | Lin X., et al. Failure of MBNL1-dependent postnatal splicing transitions in myotonic dystrophy. Hum. Mol. Genet 2006; 15: 2087-2097 |
| CAPN3 | ex 16 | Lin X., et al. Failure of MBNL1-dependent postnatal splicing transitions in myotonic dystrophy. Hum. Mol. Genet 2006; 15: 2087-2097 |
| CLCN1 | int 2, ex 7a, 8a | Mankodi A., et al. Expanded CUG repeats trigger aberrant splicing of ClC-1 chloride channel pre-mRNA and hyperexcitability of skeletal muscle in myotonic dystrophy. Mol. Cell 2002; 10: 35-44 Charlet-B N., et al. Loss of the muscle-specific chloride channel in type 1 myotonic dystrophy due to misregulated alternative splicing. Mol. Cell 2002; 10: 45-53 |
| FHOS | ex 11a | Lin X., et al. Failure of MBNL1-dependent postnatal splicing transitions in myotonic dystrophy. Hum. Mol. Genet 2006; 15: 2087-2097 |
| GFAT1 | ex 10 | Lin X., et al. Failure of MBNL1-dependent postnatal splicing transitions in myotonic dystrophy. Hum. Mol. Genet 2006; 15: 2087-2097 |
| IR | ex 11 | Savkur R. S., et al. Aberrant regulation of insulin receptor alternative splicing is associated with insulin resistance in myotonic dystrophy. Nat. Genet. 2001; 29: 40-47 |
| MBNL1 | ex 7 | Lin X., et al. Failure of MBNL1-dependent postnatal splicing transitions in myotonic dystrophy. Hum. Mol. Genet 2006; 15: 2087-2097 |
| MBNL2 | ex 7 | Lin X., et al. Failure of MBNL1-dependent postnatal splicing transitions in myotonic dystrophy. Hum. Mol. Genet 2006; 15: 2087-2097 |
| MTMR1 | ex 2.1, 2.2 | Buj-Bello A., et al. Muscle-specific alternative splicing of myotubularin-related 1 gene is impaired in DM1 muscle cells. Hum. Mol. Genet. 2002; 11: 2297-2307 |
| NRAP | ex 12 | Lin X., et al. Failure of MBNL1-dependent postnatal splicing transitions in myotonic dystrophy. Hum. Mol. Genet 2006; 15: 2087-2097 |
| RYR1 | ex 70 | Kimura T., et al. Altered mRNA splicing of the skeletal muscle ryanodine receptor and sarcoplasmic/endoplasmic reticulum Ca2+-ATPase in myotonic dystrophy type 1. Hum. Mol. Genet. 2005; 14: 2189-2200 |
| SERCA1 | ex 22 | Kimura T., et al. Altered mRNA splicing of the skeletal muscle ryanodine receptor and sarcoplasmic/endoplasmic reticulum Ca2+-ATPase in myotonic dystrophy type 1. Hum. Mol. Genet. 2005; 14: 2189-2200 Lin X., et al. Failure of MBNL1-dependent postnatal splicing transitions in myotonic dystrophy. Hum. Mol. Genet 2006; 15: 2087-2097 |
| z-Titin | ex Zr4, Zr5 | Lin X., et al. Failure of MBNL1-dependent postnatal splicing transitions in myotonic dystrophy. Hum. Mol. Genet 2006; 15: 2087-2097 |
| m-Titin | M-line ex5 | Lin X., et al. Failure of MBNL1-dependent postnatal splicing transitions in myotonic dystrophy. Hum. Mol. Genet 2006; 15: 2087-2097 |
| TNNT3 | fetal ex | Kanadia R. N., et al. A muscleblind knockout model for myotonic dystrophy. Science 2003; 302: 1978-1980 |
| ZASP | ex 11 | Lin X., et al. Failure of MBNL1-dependent postnatal splicing transitions in myotonic dystrophy. Hum. Mol. Genet 2006; 15: 2087-2097 |
| Heart | | |
| TNNT2 | ex 5 | Philips A. V., et al. Disruption of splicing regulated by a CUG-binding protein in myotonic dystrophy. Science 1998; 280: 737-741 |
| ZASP | ex 11 | Mankodi A., et al. Nuclear RNA foci in the heart in myotonic dystrophy. Circ. Res. 2005; 97: 1152-1155 |
| m-Titin | M-line ex 5 | Mankodi A., et al. Nuclear RNA foci in the heart in myotonic dystrophy. Circ. Res. 2005; 97: 1152-1155 |
| KCNAB1 | ex 2 | Mankodi A., et al. Nuclear RNA foci in the heart in myotonic dystrophy. Circ. Res. 2005; 97: 1152-1155 |
| ALP | ex 5 | (Mankodi A., et al. Nuclear RNA foci in the heart in myotonic dystrophy. Circ. Res. 2005; 97: 1152-1155 |

-continued

| Tissue/gene Target Skeletal muscle | | Reference |
|---|---|---|
| Brain | | |
| TAU | ex 2, ex 10 | Sergeant N., et al. Dysregulation of human brain microtubule-associated tau mRNA maturation in myotonic dystrophy type 1. Hum. Mol. Genet. 2001; 10: 2143-2155<br>Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |
| APP | ex 7 | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |
| NMDAR1 | ex 5 | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |

The enzymes of the present invention may target overexpressed RNA or toxic RNA, such as for example, the DMPK gene or any of the misregulated alternative splicing in DM1 skeletal muscle, heart or brain in, for example, the above table.

The enzymes of the present invention may also target trans-acting mutations affecting RNA-dependent functions that cause disease (summarized in Cell. 2009 Feb. 20; 136(4): 777-793) as indicated in the below table.

| DISEASE | GENE/MUTATION | FUNCTION |
|---|---|---|
| Prader Willi syndrome | SNORD116 | ribosome biogenesis |
| Spinal muscular atrophy (SMA) | SMN2 | splicing |
| Dyskeratosis congenita (X-linked) | DKC1 | telomerase/translation |
| Dyskeratosis congenita (autosomal dominant) | TERC | telomerase |
| Dyskeratosis congenita (autosomal dominant) | TERT | telomerase |
| Diamond-Blackfan anemia | RPS19, RPS24 | ribosome biogenesis |
| Shwachman-Diamond syndrome | SBDS | ribosome biogenesis |
| Treacher-Collins syndrome | TCOF1 | ribosome biogenesis |
| Prostate cancer | SNHG5 | ribosome biogenesis |
| Myotonic dystrophy, type 1 (DM1) | DMPK (RNA gain-of-function) | protein kinase |
| Myotonic dystrophy type 2 (DM2) | ZNF9 (RNA gain-of-function) | RNA binding |
| Spinocerebellar ataxia 8 (SCA8) | ATXN8/ATXN8OS (RNA gain-of-function) | unknown/noncoding RNA |
| Huntington's disease-like 2 (HDL2) | JPH3 (RNA gain-of-function) | ion channel function |
| Fragile X-associated tremor ataxia syndrome (FXTAS) | FMR1 (RNA gain-of-function) | translation/mRNA localization |
| Fragile X syndrome | FMR1 | translation/mRNA localization |
| X-linked mental retardation | UPF3B | translation/nonsense mediated decay |
| Oculopharyngeal muscular dystrophy (OPMD) | PABPN1 | 3' end formation |
| Human pigmentary genodermatosis | DSRAD | editing |
| Retinitis pigmentosa | PRPF31 | splicing |
| Retinitis pigmentosa | PRPF8 | splicing |
| Retinitis pigmentosa | HPRP3 | splicing |
| Retinitis pigmentosa | PAP1 | splicing |
| Cartilage-hair hypoplasia (recessive) | RMRP | splicing |
| Autism | 7q22-q33 locus breakpoint | noncoding RNA |
| Beckwith-Wiedemann syndrome (BWS) | H19 | noncoding RNA |
| Charcot-Marie-Tooth (CMT) Disease | GRS | translation |
| Charcot-Marie-Tooth (CMT) Disease | YRS | translation |
| Amyotrophic lateral sclerosis (ALS) | TARDBP | splicing, transcription |
| Leukoencephalopathy with vanishing white matter | EIF2B1 | translation |

-continued

| DISEASE | GENE/MUTATION | FUNCTION |
| --- | --- | --- |
| Wolcott-Rallison syndrome | EIF2AK3 | translation (protease) |
| Mitochondrial myopathy and sideroblastic anemia (MLASA) | PUS1 | translation |
| Encephalomyopathy and hypertrophic cardiomyopathy | TSFM | translation (mitochondrial) |
| Hereditary spastic paraplegia | SPG7 | ribosome biogenesis |
| Leukoencephalopathy | DARS2 | translation (mitochondrial) |
| Susceptibility to diabetes mellitus | LARS2 | translation (mitochondrial) |
| Deafness | MTRNR1 | ribosome biogenesis (mitochondrial) |
| MELAS syndrome, deafness | MTRNR2 | ribosome biogenesis (mitochondrial) |
| Cancer | SFRS1 | splicing, translation, export |
| Cancer | RBM5 | splicing |
| Multiple disorders | mitochondrial tRNA mutations | translation (mitochondrial) |
| Cancer | miR-17-92 cluster | RNA interference |
| Cancer | miR-372/miR-373 | RNA interference |

The enzyme of the present invention may also be used in the treatment of various tauopathies, including primary and secondary tauopathies, such as primary age-related tauopathy (PART)/Neurofibrillary tangle-predominant senile dementia, with NFTs similar to AD, but without plaques, dementia pugilistica (chronic traumatic encephalopathy), progressive supranuclear palsy, corticobasal degeneration, frontotemporal dementia and parkinsonism linked to chromosome 17, lytico-Bodig disease (Parkinson-dementia complex of Guam), ganglioglioma and gangliocytoma, meningioangiomatosis, postencephalitic parkinsonism, subacute sclerosing panencephalitis, as well as lead encephalopathy, tuberous sclerosis, Hallervorden-Spatz disease, and lipofuscinosis, Alzheime's disease. The enzymes of the present invention may also target mutations disrupting the cis-acting splicing code cause splicing defects and disease (summarized in Cell. 2009 Feb. 20; 136(4): 777-793). The motor neuron degenerative disease SMA results from deletion of the SMN1 gene. The remaining SMN2 gene has a C→T substitution in exon 7 that inactivates an exonic splicing enhancer (ESE), and creates an exonic splicing silencer (ESS), leading to exon 7 skipping and a truncated protein (SMNΔ7). A T→A substitution in exon 31 of the dystrophin gene simultaneously creates a premature termination codon (STOP) and an ESS, leading to exon 31 skipping. This mutation causes a mild form of DMD because the mRNA lacking exon 31 produces a partially functional protein. Mutations within and downstream of exon 10 of the MAPT gene encoding the tau protein affect splicing regulatory elements and disrupt the normal 1:1 ratio of mRNAs including or excluding exon 10. This results in a perturbed balance between tau proteins containing either four or three microtubule-binding domains (4R-tau and 3R-tau, respectively), causing the neuropathological disorder FTDP-17. The example shown is the N279K mutation which enhances an ESE function promoting exon 10 inclusion and shifting the balance toward increased 4R-tau. Polymorphic (UG)m(U)n tracts within the 3' splice site of the CFTR gene exon 9 influence the extent of exon 9 inclusion and the level of full-length functional protein, modifying the severity of cystic fibrosis (CF) caused by a mutation elsewhere in the CFTR gene.

The innate immune system detects viral infection primarily by recognizing viral nucleic acids inside an infected cell, referred to as DNA or RNA sensing. In vitro RNA sensing assays can be used to detect specific RNA substrates. The RNA targeting effector protein can for instance be used for RNA-based sensing in living cells. Examples of applications are diagnostics by sensing of, for examples, disease-specific RNAs.

The RNA targeting effector protein of the invention can further be used for antiviral activity, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. Provided is therefore the use of an RNA targeting effector protein of the invention as an antiviral agent.

Therapeutic dosages of the enzyme system of the present invention to target RNA the above-referenced RNAs are contemplated to be about 0.1 to about 2 mg/kg the dosages may be administered sequentially with a monitored response, and repeated dosages if necessary, up to about 7 to 10 doses per patient. Advantageously, samples are collected from each patient during the treatment regimen to ascertain the effectiveness of treatment. For example, RNA samples may be isolated and quantified to determine if expression is reduced or ameliorated. Such a diagnostic is within the purview of one of skill in the art.

Transcript Detection Methods

The effector proteins and systems of the invention are useful for specific detection of RNAs in a cell or other sample. In the presence of an RNA target of interest, guide-dependent C2c2 nuclease activity may be accompanied by non-specific RNAse activity against collateral targets. To take advantage of the rNase activity, all that is needed is a reporter substrate that can be detectably cleaved. For example, a reporter molecule can comprise RNA, tagged with a fluorescent reporter molecule (fluor) on one end and a quencher on the other. In the absence of C2c2 rNase activity, the physical proximity of the quencher dampens fluorescence from the fluor to low levels. When C2c2 target specific cleavage is activated by the presence of an RNA target-of-interest and suitable guide RNA, the RNA-containing reporter molecule is non-specifically cleaved and the fluor and quencher are spatially separated. This causes the fluor to emit a detectable signal when excited by light of the appropriate wavelength.

In an aspect, the invention relates to a (target) RNA detection system comprising an RNA targeting effector; one or more guide RNAs designed to bind to the corresponding RNA target; and an RNA-based cleavage inducible reporter construct. In another aspect, the invention relates to a method for (target) RNA detection in a sample, comprising adding an RNA targeting effector, one or more guide RNAs designed to bind to said (target) RNA, and an RNA-based cleavage inducible reporter construct to said sample. In a further aspect, the invention relates to a kit or device comprising the (target) RNA detection system as defined herein, or a kit or device comprising at least the RNA targeting effector and the RNA-based cleavage inducible reporter construct. In a further aspect, the invention relates to the use of the RNA targeting system or kit or device as defined herein for (target) RNA detection. The RNA targeting effector in certain embodiments is an RNA guided RNAse. In certain embodiments, the RNA targeting effector is a CRISPR effector. In certain embodiments, the RNA targeting effector is a class 2 CRISPR effector. In certain embodiments, the RNA targeting effector is a class 2, type VI CRISPR effector. In a preferred embodiment, the RNA targeting effector is C2c2. In certain embodiments, the RNA targeting effector, preferably C2c2, is derived from a species as described herein elsewhere. It will be understood that the guide RNA designed to bind to said (target) RNA as described herein is capable of forming a complex with the RNA targeting effector and wherein the guide RNA in said complex is capable of binding to a target RNA molecule and whereby the target RNA is cleaved, as also described herein elsewhere. It will be understood that the guide RNA typically comprises a guide sequence and a direct repeat, as described herein elsewhere. In certain embodiments, the one or more guide RNAs are designed to bind to one or more target molecules that are diagnostic for a disease state. In certain embodiments, the disease state is infection, such as viral, bacterial, fungal, or parasitic infection. In certain embodiments, the disease state is characterised by aberrant (target) RNA expression. In certain embodiments, the disease state is cancer. In certain embodiments, the disease state is autoimmune disease. The RNA-based cleavage inducible reporter construct comprises RNA and cleavage of the RNA results in a detectable readout, i.e. a detectable signal is generated upon cleavage of the RNA. In certain embodiments, the RNA-based cleavage inducible reporter construct comprises a fluorochrome and a quencher. The skilled person will understand that different types of fluorochromes and corresponding quenchers may be used. The skilled person will readily envisage other types of inducible reporter systems which may be adapted for use in the present RNA cleavage reporter constructs.

In one exemplary assay method, C2c2 effector, target-of-interest-specific guide RNA, and reporter molecule are added to a cellular sample. An increase in fluorescence indicates the presence of the RNA target-of-interest. In another exemplary method, a detection array is provided. Each location of the array is provided with C2c2 effector, reporter molecule, and a target-of-interest-specific guide RNA. Depending on the assay to be performed, the target-of-interest-specific guide RNAs at each location of the array can be the same, different, or a combination thereof. Different target-of-interest-specific guide RNAs might be provided, for example when it is desired to test for one or more targets in a single source sample. The same target-of-interest-specific guide RNA might be provided at each location, for example when it is desired to test multiple samples for the same target.

As used herein, a "masking construct" refers to a molecule that can be cleaved or otherwise deactivated by an activated CRISPR system effector protein described herein. In certain example embodiments, the masking construct is a RNA-based masking construct. The masking construct prevents the generation or detection of a positive detectable signal. A positive detectable signal may be any signal that can be detected using optical, fluorescent, chemiluminescent, electrochemical or other detection methods known in the art. The masking construct may prevent the generation of a detectable positive signal or mask the presence of a detectable positive signal until the masking construct is removed or otherwise silenced. The term "positive detectable signal" is used to differentiate from other detectable signals that may be detectable in the presence of the masking construct. For example, in certain embodiments a first signal may be detected when the masking agent is present (i.e. a negative detectable signal), which then converts to a second signal (e.g. the positive detectable signal) upon detection of the target molecules and cleavage or deactivation of the masking agent by the activated CRISPR effector protein.

In certain example embodiments, the masking construct may suppress generation of a gene product. The gene product may be encoded by a reporter construct that is added to the sample. The masking construct may be an interfering RNA involved in a RNA interference pathway, such as a shRNA or siRNA. The masking construct may also comprise microRNA (miRNA). While present, the masking construct suppresses expression of the gene product. The gene product may be a fluorescent protein or other RNA transcript or proteins that would otherwise be detectable by a labeled probe or antibody but for the presence of the masking construct. Upon activation of the effector protein the masking construct is cleaved or otherwise silenced allowing for expression and detection of the gene product as the positive detectable signal.

In certain example embodiments, the masking construct may sequester one or more reagents needed to generate a detectable positive signal such that release of the one or more reagents from the masking construct results in generation of the detectable positive signal. The one or more reagents may combine to produce a colorimetric signal, a chemiluminescent signal, a fluorescent signal, or any other detectable signal and may comprise any reagents known to be suitable for such a purpose. In certain example embodiments, the one or more reagents are sequestered by RNA aptamers that bind the one or more reagents. The one or more reagents are released when the effector protein is activated upon detection of a target molecule. In certain example embodiments, the one or more reagents is a protein, such as an enzyme, capable of facilitating generation of a detectable signal, such as a colorimetric, chemiluminescent, or fluorescent signal, that is inhibited or sequestered such that the protein cannot generate the detectable signal by the binding of one or more RNA aptamers to the protein. Upon activation of the effector proteins disclosed herein, the RNA aptamers are cleaved or degraded to the extent they no longer inhibit the protein's ability to generate the detectable signal.

In one embodiment, thrombin is used as a signal amplification enzyme with an inhibitory aptamer, for example having the following sequence: GGGAACAAAGCUGA-AGUACUUACCC (SEQ ID NO: 56). When this aptamer is cleaved, thrombin becomes active and will cleave a peptide colorimetric substrate (see, e.g., www.sigmaaldrich.com/catalog/product/sigma/t3068?lang=en&region=US) or fluorescent substrate (see, e.g., www.sigmaaldrich.com/catalog/ product/sigma/b9385?lang=en&region=US). The colorimetric substrate, para-nitroaniline (pNA), is covalently linked to the peptide substrate for thrombin. Upon cleavage by thrombin, pNA is released and becomes yellow in color and easily visible by eye. The fluorescent substrate operates by a similar principle and, upon cleavage by thrombin, releases 7-amino-4-methylcoumarin, a blue fluorophore that can be detected using a fluorescence detector. Alternatives to thrombin include horseradish peroxidase (HRP), β-galactosidase, and calf alkaline phosphatase (CAP) which can similarly be used to generate a colorimetric or fluorescent signal, and be inhibited by an inhibitory aptamer.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is a RNA-based aptamer that can be cleaved by the activated effector protein upon detection of a target molecule.

In certain other example embodiments, the masking construct binds to an immobilized reagent in solution thereby blocking the ability of the reagent to bind to a separate labeled binding partner that is free in solution. Thus, upon application of a washing step to a sample, the labeled binding partner can be washed out of the sample in the absence of a target molecule. However, if the effector protein is activated, the masking construct is cleaved to a degree sufficient to interfere with the ability of the masking construct to bind the reagent thereby allowing the labeled binding partner to bind to the immobilized reagent. Thus, the labeled binding partner remains after the wash step indicating the presence of the target molecule in the sample. In certain aspects, the masking construct that binds the immobilized reagent is a RNA aptamer. The immobilized reagent may be a protein and the labeled minding partner may be a labeled antibody. Alternatively, the immobilized reagent may be a streptavidin and the labeled binding partner may be labeled biotin. The label on the binding partner used in the above embodiments may be any detectable label known in the art. In addition, other known binding partners may be used in accordance with the overall design described here.

In certain example embodiments, the masking construct may comprise a ribozyme. Ribozymes are RNA molecules having catalytic properties. As ribozymes, both naturally and engineered, comprise or consist of RNA, that may be targeted by the effector proteins disclosed herein. The ribozyme may be selected or engineered to catalyze a reaction that either generates a negative detectable signal or prevents generation of a positive control signal. Upon deactivation of the ribozyme by the activated effector protein molecule the reaction generating a negative controls signal or preventing generation of a positive detectable signal is removed, thereby allowing a positive detectable signal to be detected. In one example embodiment, the ribozyme may catalyze a colorimetric reaction causing a solution to appear as a first color. When the ribozyme is deactivated the solution then turns to a second color, the second color being the detectable positive signal. An example of how ribozymes can be used to catalyze a colorimetric reaction are described in Zhao et al. "Signal amplification of glucosamine-6-phosphate based on ribozyme glmS," Biosens Bioelectron. 2014; 16:337-42, and provide an example of how such a system could be modified to work in the context of the embodiments disclosed herein. Alternatively, ribozymes, when present can generate cleavage products of, for example, RNA transcripts. Thus, detection of a positive detectable signal may comprise detection of non-cleaved RNA transcripts that are only generated in the absence of the ribozyme.

In one example embodiment, the masking construct comprises a detection agent that changes color depending on whether the detection agent is aggregated or dispersed in solution. For example, certain nanoparticles, such as colloidal gold, undergo a visible purple to red color shift as they move from aggregates to dispersed particles. Accordingly, in certain example embodiments, such detection agents may be held in aggregate by one or more bridge molecules. At least a portion of the bridge molecule comprises RNA. Upon activation of the effector proteins disclosed herein, the RNA portion of the bridge molecule is cleaved allowing the detection agent to disperse and resulting in the corresponding change in color. In certain example embodiments the, bridge molecule is a RNA molecule. In certain example embodiments, the detection agent is a colloidal metal. The colloidal metal material may include water-insoluble metal particles or metallic compounds dispersed in a liquid, a hydrosol, or a metal sol. The colloidal metal may be selected from the metals in groups IA, IB, IIB and IIIB of the periodic table, as well as the transition metals, especially those of group VIII. Preferred metals include gold, silver, aluminum, ruthenium, zinc, iron, nickel and calcium. Other suitable metals also include the following in all of their various oxidation states: lithium, sodium, magnesium, potassium, scandium, titanium, vanadium, chromium, manganese, cobalt, copper, gallium, strontium, niobium, molybdenum, palladium, indium, tin, tungsten, rhenium, platinum, and gadolinium. The metals are preferably provided in ionic form, derived from an appropriate metal compound, for example the $Al^{3+}$, $Ru^{3+}$, $Zn^{2+}$, $Fe^{3+}$, $Ni^{2+}$ and $Ca^{2+}$ ions.

In certain other example embodiments, the masking construct may comprise an RNA oligonucleotide to which are attached a detectable label and a masking agent of that detectable label. An example of such a detectable label/masking agent pair is a fluorophore and a quencher of the fluorophore. Quenching of the fluorophore can occur as a result of the formation of a non-fluorescent complex between the fluorophore and another fluorophore or non-fluorescent molecule. This mechanism is known as ground-state complex formation, static quenching, or contact quenching. Accordingly, the RNA oligonucleotide may be designed so that the fluorophore and quencher are in sufficient proximity for contact quenching to occur. Fluorophores and their cognate quenchers are known in the art and can be selected for this purpose by one having ordinary skill in the art. The particular fluorophore/quencher pair is not critical in the context of this invention, only that selection of the fluorophore/quencher pairs ensures masking of the fluorophore. Upon activation of the effector proteins disclosed herein, the RNA oligonucleotide is cleaved thereby severing the proximity between the fluorophore and quencher needed to maintain the contact quenching effect. Accordingly, detection of the fluorophore may be used to determine the presence of a target molecule in a sample.

In one example embodiment, the masking construct may comprise a quantum dot. The quantum dot may have multiple linker molecules attached to the surface. At least a portion of the linker molecule comprises RNA. The linker molecule is attached to the quantum dot at one end and to one or more quenchers along the length or at terminal ends of the linker such that the quenchers are maintained in sufficient proximity for quenching of the quantum dot to occur. The linker may be branched. As above, the quantum dot/quencher pair is not critical, only that selection of the quantum dot/quencher pair ensures masking of the fluorophore. Quantum dots and their cognate quenchers are known in the art and can be selected for this purpose by one having ordinary skill in the art. Upon activation of the effector proteins disclosed herein, the RNA portion of the linker molecule is cleaved thereby eliminating the proximity between the quantum dot and one or more quenchers needed to maintain the quenching effect. In one embodiment, the quantum dot is streptavidin conjugated, such as Qdot® 625 Streptavidin Conjugate (www.thermofisher.com/order/catalog/product/A10196). RNA are attached via biotin linkers and recruit quenching molecules, with the sequence /5Biosg/ UCUCGUACGUUC/3IAbRQSp/ (SEQ ID NO: 57) or /5Biosg/UCUCGUACGUUCUCUCGUACGUUC/ 3IAbRQSp/ (SEQ ID NO: 58) where /5Biosg/ is a biotin tag and /3IAbRQSp/ is an Iowa black quencher. Upon cleavage, the quencher will be released and the quantum dot will fluoresce visibly.

In a similar fashion, fluorescence energy transfer (FRET) may be used to generate a detectable positive signal. FRET is a non-radiative process by which a photon from an energetically excited fluorophore (i.e. "donor fluorophore") raises the energy state of an electron in another molecule (i.e. "the acceptor") to higher vibrational levels of the excited singlet state. The donor fluorophore returns to the ground state without emitting a fluoresce characteristic of that fluorophore. The acceptor can be another fluorophore or non-fluorescent molecule. If the acceptor is a fluorophore, the transferred energy is emitted as fluorescence characteristic of that fluorophore. If the acceptor is a non-fluorescent molecule the absorbed energy is loss as heat. Thus, in the context of the embodiments disclosed herein, the fluorophore/quencher pair is replaced with a donor fluorophore/ acceptor pair attached to the oligonucleotide molecule. When intact, the masking construct generates a first signal (negative detectable signal) as detected by the fluorescence or heat emitted from the acceptor. Upon activation of the effector proteins disclosed herein the RNA oligonucleotide is cleaved and FRET is disrupted such that fluorescence of the donor fluorophore is now detected (positive detectable signal).

One mode of colorimetric readout for the detection of RNAses is based upon intercalating dyes, which change their absorbance in response to cleavage of long RNAs to short nucleotides. Several existing dyes with these properties exist. From Wagner (1983), Pyronine-Y will complex with RNA and form a complex that has an absorbance at 572 nm; cleavage of RNA results in loss of absorbance and a color change. Greiner-Stoeffele (1996) used methylene blue in a similar fashion, with changes in absorbance at 688 nm upon RNAse activity.

Another mode of colorimetric readout involves nucleic acid substrates that change color upon cleavage. Witmer (1991) utilized a synthetic ribonucleotide substrate, U-3'- BCIP, that releases a reporter group after cleavage, resulting in generation of absorbance at 650 nm.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,999,641, 8,993,233, 8,945,839, 8,932,814, 8,906,616, 8,895,308, 8,889,418, 8,889,356, 8,871,445, 8,865,406, 8,795,965, 8,771,945 and 8,697,359; US Patent Publications US 2014-0310830 (U.S. application Ser. No. 14/105,031), US 2014-0287938 A1 (U.S. application Ser. No. 14/213, 991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014- 0234972 A1 (U.S. application Ser. No. 14/183,471), US 2014-0227787 A1 (U.S. application Ser. No. 14/256,912), US 2014-0189896 A1 (U.S. application Ser. No. 14/105, 035), US 2014-0186958 (U.S. application Ser. No. 14/105, 017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patents EP 2 784 162 B1 and EP 2 771 468 B1; European Patent Applications EP 2 771 468 (EP13818570.7), EP 2 764 103 (EP13824232.6), and EP 2 784 162 (EP14170383.5); and PCT Patent Publications PCT Patent Publications WO 2014/093661 (PCT/ US2013/074743), WO 2014/093694 (PCT/US2013/ 074790), WO 2014/093595 (PCT/US2013/074611), WO 2014/093718 (PCT/US2013/074825), WO 2014/093709 (PCT/US2013/074812), WO 2014/093622 (PCT/US2013/ 074667), WO 2014/093635 (PCT/US2013/074691), WO 2014/093655 (PCT/US2013/074736), WO 2014/093712 (PCT/US2013/074819), WO 2014/093701 (PCT/US2013/ 074800), WO 2014/018423 (PCT/US2013/051418), WO 2014/204723 (PCT/US2014/041790), WO 2014/204724 (PCT/US2014/041800), WO 2014/204725 (PCT/US2014/ 041803), WO 2014/204726 (PCT/US2014/041804), WO 2014/204727 (PCT/US2014/041806), WO 2014/204728 (PCT/US2014/041808), WO 2014/204729 (PCT/US2014/ 041809). Reference is also made to U.S. provisional patent applications 61/758,468; 61/802,174; 61/806,375; 61/814, 263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/ US2014/041809, PCT/US2014/041804 and PCT/US2014/ 041806, each filed Jun. 10, 2014; 6/10/14; PCT/US2014/ 041808 filed Jun. 11, 2014; and PCT/US2014/62558 filed Oct. 28, 2014, and U.S. Provisional Patent Applications Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Reference is made to US provisional patent application U.S. Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013.

Mention is also made of U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. application 62/091,462, 12 Dec. 2014, DEAD GUIDES FOR CRISPR TRANSCRIPTION FACTORS; U.S. application 62/096,324, 23 Dec. 2014, DEAD GUIDES FOR CRISPR TRANSCRIPTION FACTORS; U.S. application 62/091,456, 12 Dec. 2014, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOIETIC STEM CELLS (HSCs); U.S. application 62/094,903, 19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014, RNA-TARGETING SYSTEM; U.S. application 62/096,656, 24 Dec. 2014, CRISPR HAVING OR ASSOCIATED WITH DESTABILIZATION DOMAINS; U.S. application 62/096,697, 24 Dec. 14, CRISPR HAVING OR ASSOCIATED WITH AAV; U.S. application 62/098,158, 30 Dec. 2014, ENGINEERED CRISPR COMPLEX INSERTIONAL TARGETING SYSTEMS; U.S. application 62/151,052, 22 Apr. 15, CELLULAR TARGETING FOR EXTRACELLULAR EXOSOMAL REPORTING; U.S. application 62/054,490, 24 Sep. 14, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 62/055,484, 25 Sep. 14, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/054,675, 24 Sep. 14, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 14, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 14, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25Sep. 14, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014, FUNCTIONAL SCREENING WITH OPTIMIZED FUNCTIONAL CRISPR-CAS SYSTEMS; U.S. application 62/055,487, 25 Sep. 14, FUNCTIONAL SCREENING WITH OPTIMIZED FUNCTIONAL CRISPR-CAS SYSTEMS; U.S. application 62/087,546, 4 Dec. 2014, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN VIVO MODELING AND GENETIC SCREENING OF TUMOR GROWTH AND METASTASIS.

Each of these patents, patent publications, and applications, and all documents cited therein or during their prosecution ("appln. cited documents") and all documents cited or referenced in the appln. cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln. cited documents) are incorporated herein by reference to the same extent as if each individual document was specifically and individually indicated to be incorporated by reference.

Also with respect to general information on CRISPR-Cas Systems, mention is made of the following (also hereby incorporated herein by reference):

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);

Genome engineering using the CRISPR-Cas9 system. Ran, F A., Hsu, P D., Wright, J., Agarwala, V., Scott, D A., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science Dec. 12, 2013. [Epub ahead of print];

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014 (2014);

Development and Applications of CRISPR-Cas9 for Genome Engineering, Hsu P D, Lander E S, Zhang F., Cell. June 5; 157(6):1262-78 (2014);

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki O, Zhang F., Nature. January 29; 517(7536):583-8 (2015);

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using Staphylococcus aureus Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520(7546):186-91 (2015);

Shalem et al., "High-throughput functional genomics using CRISPR-Cas9," Nature Reviews Genetics 16, 299-311 (May 2015);

Xu et al., "Sequence determinants of improved CRISPR sgRNA design," Genome Research 25, 1147-1157 (August 2015);

Parnas et al., "A Genome-wide CRISPR Screen in Primary Immune Cells to Dissect Regulatory Networks," Cell 162, 675-686 (Jul. 30, 2015)'

Ramanan et al., CRISPR/Cas9 cleavage of viral DNA efficiently suppresses hepatitis B virus," Scientific Reports 5:10833. doi: 10.1038/srep10833 (Jun. 2, 2015);

Nishimasu et al., "Crystal Structure of Staphylococcus aureus Cas9," Cell 162, 1113-1126 (Aug. 27, 2015);

Zetsche et al. (2015), "Cpf1 is a single RNA-guided endonuclease of a class 2 CRISPR-Cas system," Cell 163, 759-771 (Oct. 22, 2015) doi: 10.1016/j.cell.2015.09.038. Epub Sep. 25, 2015;

Shmakov et al. (2015), "Discovery and Functional Characterization of Diverse Class 2 CRISPR-Cas Systems," Molecular Cell 60, 385-397 (Nov. 5, 2015) doi: 10.1016/j.molcel.2015.10.008. Epub Oct. 22, 2015;

Dahlman et al., "Orthogonal gene control with a catalytically active Cas9 nuclease," Nature Biotechnology 33, 1159-1161 (November, 2015);

Gao et al, "Engineered Cpf1 Enzymes with Altered PAM Specificities," bioRxiv 091611; doi: http://dx.doi.org/10.1101/091611 Epub Dec. 4, 2016;

Smargon et al. (2017), "Cas13b Is a Type VI-B CRISPR-Associated RNA-Guided rNase Differentially Regulated by Accessory Proteins Csx27 and Csx28," Molecular Cell 65, 618-630 (Feb. 16, 2017) doi: 10.1016/j.molcel.2016.12.023. Epub Jan. 5, 2017;

each of which is incorporated herein by reference, may be considered in the practice of the instant invention, and discussed briefly below:

Cong et al. engineered type II CRISPR-Cas systems for use in eukaryotic cells based on both Streptococcus thermophilus Cas9 and also Streptococcus pyogenes Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR/Cas system for the one-step generation of mice carrying mutations in multiple genes which were traditionally generated in multiple steps by sequential recombination in embryonic stem cells and/or time-consuming intercrossing of mice with a single mutation. The CRISPR/Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors.

Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays. Shalem et al. (2015) described ways in which catalytically inactive Cas9 (dCas9) fusions are used to synthetically repress (CRISPRi) or activate (CRISPRa) expression, showing advances using Cas9 for genome-scale screens, including arrayed and pooled screens, knockout approaches that inactivate genomic loci and strategies that modulate transcriptional activity.

Shalem et al. (2015) described ways in which catalytically inactive Cas9 (dCas9) fusions are used to synthetically repress (CRISPRi) or activate (CRISPRa) expression, showing advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the "-TTGAAT-" PAM and the "-TTGGGT-" PAM. A structural comparison of SaCas9 with SpCas9 highlighted both structural conservation and divergence, explaining their distinct PAM specificities and orthologous sgRNA recognition.

Zetsche et al. (2015) reported the characterization of Cpf1, a putative class 2 CRISPR effector. It was demonstrated that Cpf1 mediates robust DNA interference with features distinct from Cas9. Identifying this mechanism of interference broadens our understanding of CRISPR-Cas systems and advances their genome editing applications.

Shmakov et al. (2015) reported the characterization of three distinct Class 2 CRISPR-Cas systems. The effectors of two of the identified systems, C2c1 and C2c3, contain RuvC like endonuclease domains distantly related to Cpf1. The third system, C2c2, contains an effector with two predicted HEPN rNase domains.

Gao et al. (2016) reported using a structure-guided saturation mutagenesis screen to increase the targeting range of Cpf1. AsCpf1 variants were engineered with the mutations S542R/K607R and S542R/K548V/N552R that can cleave target sites with TYCV/CCCC and TATV PAMs, respectively, with enhanced activities in vitro and in human cells.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In addition, mention is made of PCT application PCT/US14/70057, entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, with respect to a method of preparing an sgRNA-and-Cas9 protein containing particle comprising admixing a mixture comprising an sgRNA and Cas9 protein (and optionally HDR template) with a mixture comprising or consisting essentially of or consisting of surfactant, phospholipid, biodegradable polymer, lipoprotein and alcohol; and particles from such a process. For example, wherein Cas9 protein and sgRNA were mixed together at a suitable, e.g., 3:1 to 1:3 or 2:1 to 1:2 or 1:1 molar ratio, at a suitable temperature, e.g., 15-30° C., e.g., 20-25° C., e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a $C_{1-6}$ alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cas9 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5, DOTAP 100, DMPC 0, PEG 0, Cholesterol 0. That application accordingly comprehends admixing sgRNA, Cas9 protein and components that form a particle; as well as particles from such admixing. Aspects of the instant invention can involve particles; for example, particles using a process analogous to that of the Particle Delivery PCT, e.g., by admixing a mixture comprising sgRNA and/or Cas9 as in the instant invention and components that form a particle, e.g., as in the Particle Delivery PCT, to form a particle and particles from such admixing (or, of course, other particles involving sgRNA and/or Cas9 as in the instant invention).

EXAMPLES

Example 1: Characterization of Cas13a Family

Figure 56A:
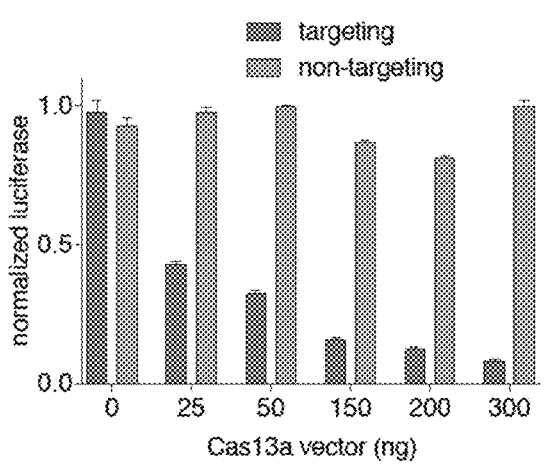
Figure 56B:
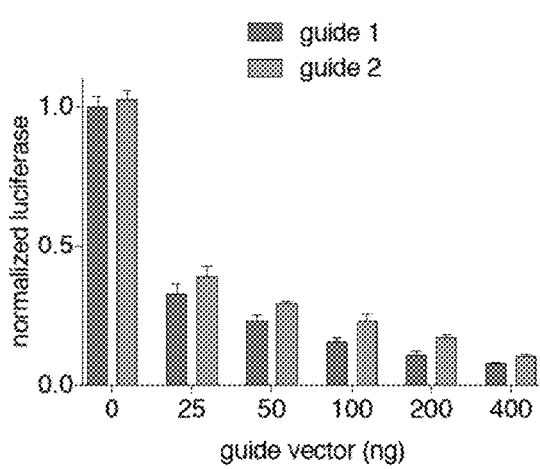
Figure 56C:
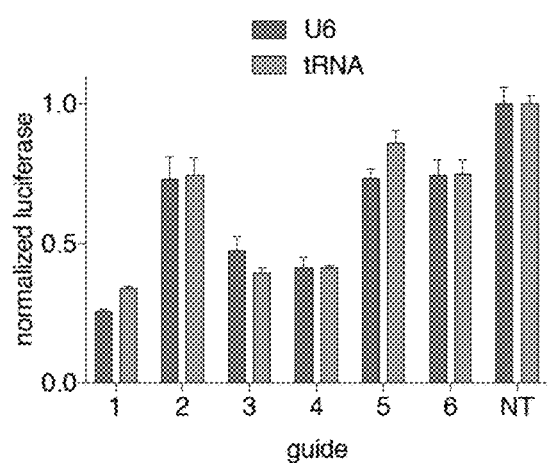
Figure 56D:
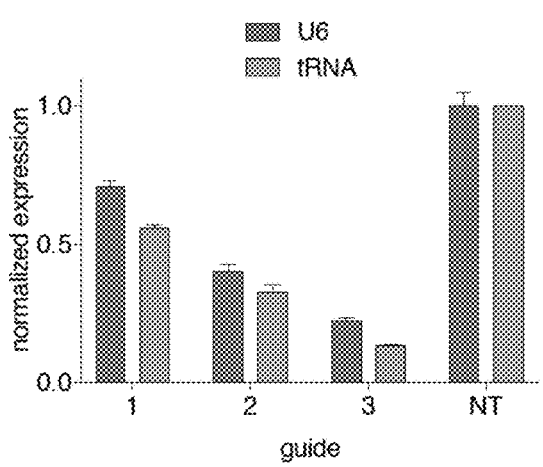

Applicants comprehensively evaluated fifteen Cas13a orthologs for PFS preference and activity (FIG. 57A) using an ampicillin resistance bacterial assay (FIG. 3A). Briefly, Cas13a is programmed to target a 5' stretch of sequence on the P-lactamase transcript flanked by randomized PFS nucleotides. Cas13a cleavage activity results in death of bacteria under ampicillin selection and PFS depletion is subsequently analyzed by next generation sequencing. In order to allow for quantitative comparisons between orthologs, Applicants cloned each Cas13a ortholog under a pLac promoter along with a single-spacer CRISPR array nearby under expression of the pJ23119 small RNA promoter. After co-transformation of the PFS plasmid library with each of the Cas13a ortholog plasmids in *E. coli*, Applicants measured bacteria survival via transformant counting and found that the Cas13a ortholog from *Leptotrichia wadei* (LwaCas13a) was most active, followed by *Leptotrichia shahii* Cas13a (LshCas13a) (FIG. 3C, D). Next generation sequencing analysis of the PFS distributions from LwaCas13a and LshCas13a screens revealed that most LwCas13a PFS sequences were depleted (FIGS. 3G and 57B, C), suggesting robust LwCas13a RNA cleavage activity. Indeed, motif analysis of the depleted PFS sequences at varying thresholds revealed the expected 3' H motif of LshCas13a, but no significant PFS motif for LwCas13a (FIGS. 3H, 56D, E). In the recent development of LwCas13a for nucleic acid detection, Applicants found LwCas13a to be more active than LshCas13a and found a weak 3' H PFS by biochemical characterization. LwCas13a was found to be most active of the fifteen Cas13a orthologs tested and to have no PFS in bacteria.

Example 2: Expression of C2c2 in Eukaryotic Cells

The following C2c2 orthologues were codon optimized for expression in mammalian cells.

| C2c2 orthologue | Code | Multi Letter |
|---|---|---|
| *Leptotrichia shahii* | C2-2 | Lsh |
| *L wadei* F0279 (Lw2) | C2-3 | Lw2 |
| *Listeria seeliged* | C2-4 | Lse |
| Lachnospiraceae bacterium MA2020 | C2-5 | LbM |
| Lachnospiraceae bacterium NK4A179 | C2-6 | LbNK179 |
| [*Clostridium*] *aminophilum* DSM 10710 | C2-7 | Ca |
| *Carnobacterium gallinarum* DSM 4847 | C2-8 | Cg |
| *Carnobacterium gallinarum* DSM 4847 | C2-9 | Cg2 |
| *Paludibacter propionicigenes* WB4 | C2-10 | Pp |
| *Listeria weihenstephanensis* FSL R9-0317 | C2-11 | Lwei |
| *Listeriaceae bacterium* FSL M6-0635 | C2-12 | LbFSL |
| *Leptotrichia wadei* F0279 | C2-13 | Lw |
| *Rhodobacter capsulatus* SB 1003 | C2-14 | Rc |
| *Rhodobacter capsulatus* R121 | C2-15 | Rc |
| *Rhodobacter capsulatus* DE442 | C2-16 | Rc |

The protein sequences of the above species are listed in the Table below.

| | | | |
|---|---|---|---|
| c2c2-5 | 1 | Lachnospiraceae bacterium MA2020 | MQISKVNHKHVAVGQKDRERITGFIYNDPVGDEKSLEDVVAKRA NDTKVLFNVFNTKDLYDSQESDKSEKDKEIISKGAKFVAKSFNSAI TILKKQNKIYSTLTSQQVIKELKDKFGGARIYDDDIEEALTETLKKS FRKENVRNSIKVLIENAAGIRSSLSKDEEELIQEYFVKQLVEEYTKT KLQKNVVKSIKNQNMVIQPDSDSQVLSLSESRREKQSSAVSSDTLV NCKEKDVLKAFLTDYAVLDEDERNSLLWKLRNLVNLYFYGSESIR DYSYTKEKSVWKEHDEQKANKTLFIDEICHITKIGKNGKEQKVLD YEENRSRCRKQNINYYRSALNYAKNNTSGIFENEDSNHFWHLIEN EVERLYNGIENGEEFKFETGYISEKVWKAVINHLSIKYIALGKAVY NYAMKELSSPGDIEPGKIDDSYINGITSFDYEIIKAEESLQRDISMNV VFATNYLACATVDTDKDFLLFSKEDIRSCTKKDGNLCKNIMQFWG GYSTWKNFCEEYLKDDKDALELLYSLKSMLYSMRNSSPHFSTENV DNGSWDTELIGKLFEEDCNRAARIEKEKFYNNNLHMFYSSSLLEK VLERIYSSHHERASQVPSFNRVFVRKNPPSSLSEQRITPKFTDSKDE QIWQSAVYYLCKEIYYNDFLQSKEAYKLFREGVKNLDKNDINNQK AADSFKQAVVYYGKAIGNATLSQVCQAIMTEYNRQNNDGLKKKS AYAEKQNSNKYKHYPLFLKQVLQSAFWEYLDENKEIYGFISAQIH KSNVEIKAEDFIANYSSQQYKKLVDKVKKTPELQKWYTLGRLINP RQANQFLGSIRNYVQFVKDIQRRAKENGNPIRNYYEVLESDSIIKIL EMCTKLNGTTSNDIHDYFRDEDEYAEYISQFVNFGDVHSGAALNA FCNSESEGKKNGIYYDGINPIVNRNWVLCKLYGSPDLISKIISRVNE NMIHDFHKQEDLIREYQIKGICSNKKEQQDLRTFQVLKNRVELRDI VEYSEIINELYGQLIKWCYLRERDLMYFQLGFHYLCLNNASSKEA |

-continued

```
                            DYIKINVDDRNISGAILYQIAAMYINGLPVYYKKDDMYVALKSGK
                            KASDELNSNEQTSKKINYFLKYGNNILGDKKDQLYLAGLELFENV
                            AEHENIIIFRNEIDHFHYFYDRDRSMLDLYSEVFDRFFTYDMKLRK
                            NVVNMLYNILLDHNIVSSFVFETGEKKVGRGDSEVIKPSAKIRLRA
                            NNGVSSDVFTYKVGSKDELKIATLPAKNEEFLLNVARLIYYPDME
                            AVSENMVREGVVKVEKSNDKKGKISRGSNTRSSNQSKYNNKSKN
                            RMNYSMGSIFEKMDLKFD (SEQ ID NO: 59)

c2c2-6  2  Lachnospiraceae   MKISKVREENRGAKLTVNAKTAVVSENRSQEGILYNDPSRYGKSR
           bacterium         KNDEDRDRYIESRLKSSGKLYRIFNEDKNKRETDELQWFLSEIVKK
           NK4A179           INRRNGLVLSDMLSVDDRAFEKAFEKYAELSYTNRRNKVSGSPAF
                            ETCGVDAATAERLKGIISETNFINRIKNNIDNKVSEDIIDRIIAKYLK
                            KSLCRERVKRGLKKLLMNAFDLPYSDPDIDVQRDFIDYVLEDFYH
                            VRAKSQVSRSIKNMNMPVQPEGDGKFAITVSKGGTESGNKRSAEK
                            EAFKKFLSDYASLDERVRDDMLRRMRRLVVLYFYGSDDSKLSDV
                            NEKFDVWEDHAARRVDNREFIKLPLENKLANGKTDKDAERIRKN
                            TVKELYRNQNIGCYRQAVKAVEEDNNGRYFDDKMLNMFFIHRIE
                            YGVEKIYANLKQVTEFKARTGYLSEKIWKDLINYISIKYIAMGKAV
                            YNYAMDELNASDKKEIELGKISEEYLSGISSFDYELIKAEEMLQRET
                            AVYVAFAARHLSSQTVELDSENSDFLLLKPKGTMDKNDKNKLAS
                            NNILNFLKDKETLRDTILQYFGGHSLWTDFPFDKYLAGGKDDVDF
                            LTDLKDVIYSMRNDSFHYATENHNNGKWNKELISAMFEHETERM
                            TVVMKDKFYSNNLPMFYKNDDLKKLLIDLYKDNVERASQVPSFN
                            KVFVRKNFPALVRDKDNLGIELDLKADADKGENELKFYNALYYM
                            FKEIYYNAFLNDKNVRERFITKATKVADNYDRNKERNLKDRIKSA
                            GSDEKKKLREQLQNYIAENDFGQRIKNIVQVNPDYTLAQICQLIMT
                            EYNQQNNGCMQKKSAARKDINKDSYQHYKMLLLVNLRKAFLEFI
                            KENYAFVLKPYKHDLCDKADFVPDFAKYVKPYAGLISRVAGSSEL
                            QKWYIVSRFLSPAQANHMLGFLHSYKQYVWDIYRRASETGTEINH
                            SIAEDKIAGVDITDVDAVIDLSVKLCGTISSEISDYFKDDEVYAEYIS
                            SYLDFEYDGGNYKDSLNRFCNSDAVNDQKVALYYDGEHPKLNRN
                            IILSKLYGERRFLEKITDRVSRSDIVEYYKLKKETSQYQTKGIFDSED
                            EQKNIKKFQEMKNIVEFRDLMDYSEIADELQGQLINWIYLRERDL
                            MNFQLGYHYACLNNDSNKQATYVTLDYQGKKNRKINGAILYQIC
                            AMYINGLPLYYVDKSSEWTVSDGKESTGAKIGEFYRYAKSFENT
                            SDCYASGLEIFENISEHDNITELRNYIEHFRWSSFDRSFLGIYSEVF
                            DRFFTYDLKYRKNVPTILYNILLQHFVNVRFEFVSGKKMIGIDKKD
                            RKIAKEKECARITIREKNGVYSEQFTYKLKNGTVYVDARDKRYLQ
                            SIIRLLFYPEKVNMDEMIEVKEKKKPSDNNTGKGYSKRDRQQDRK
                            EYDKYKEKKKKEGNFLSGMGGNINWDEINAQLKN (SEQ ID NO: 60)

c2c2-7  3  [Clostridium]    MKFSKVDHTRSAVGIQKATDSVHGMLYTDPKKQEVNDLDKRFDQ
           aminophilum      LNVKAKRLYNVFNQSKAEEDDDEKRFGKVVKKLNRELKDLLFHR
           DSM              EVSRYNSIGNAKYNYYGIKSNPEEIVSNLGMVESLKGERDPQKVIS
           10710            KLLLYYLRKGLKPGTDGLRMILEASCGLRKLSGDEKELKVFLQTL
                            DEDFEKKTFKKNLIRSIENQNMAVQPSNEGDPIIGITQGRFNSQKNE
                            EKSAIERMMSMYADLNEDHREDVLRKLRRLNVLYFNVDTEKTEE
                            PTLPGEVDTNPVFEVWHDHEKGKENDRQFATFAKILTEDRETRKK
                            EKLAVKEALNDLKSAIRDHNIMAYRCSIKVTEQDKDGLFFEDQRIN
                            RFWIHHIESAVERILASINPEKLYKLRIGYLGEKVWKDLLNYLSIKY
                            IAVGKAVFHFAMEDLGKTGQDIELGKLSNSVSGGLTSFDYEQIRAD
                            ETLQRQLSVEVAFAANNLFRAWGQTGKKIEQSKSEENEEDFLLW
                            KAEKIAESIKKEGEGNTLKSILQFFGGASSWDLNHFCAAYGNESSA
                            LGYETKFADDLRKAIYSLRNETFHFTTLNKGSFDWNAKLIGDMFS
                            HEAATGIAVERTRFYSNNLPMFYRESDLKRIMDHLYNTYHPRASQ
                            VPSFNSVFVRKNFRLFLSNTLNTNTSFDTEVYQKWESGVYYLFKEI
                            YYNSFLPSGDAHHLFFEGLRRIRKEADNLPIVGKEAKKRNAVQDF
                            GRRCDELKNLSLSAICQMIMTEYNEQNNGNRKVKSTREDKRKPDI
                            FQHYKMLLLRTLQEAFAIYIRREEFKFIFDLPKTLYVMKPVEEFLPN
                            WKSGMFDSLVERVKQSPDLQRWYVLCKFLNGRLLNQLSGVIRSYI
                            QFAGDIQRRAKANHNRLYMDNTQRVEYYSNVLEVVDFCIKGTSR
                            FSNVFSDYFRDEDAYADYLDNYLQFKDEKIAEVSSFAALKTFCNE
                            EEVKAGIYMDGENPVMQRNIVMAKLFGPDEVLKNVVPKVTREEIE
                            EYYQLEKQIAPYRQNGYCKSEEDQKKLLRFQRIKNRVEFQTITEFS
                            EIINELLGQLISWSFLRERDLLYFQLGFHYLCLHNDTEKPAEYKEIS
                            REDGTVIRNAILHQVAAMYVGGLPVYTLADKKLAAFEKGEADCK
                            LSISKDTAGAGKKIKDFFRYSKYVLIKDRMLTDQNQKYTIYLAGLE
                            LFENTDEHDNITDVRKYVDHFKYYATSDENAMSILDLYSEIHDRFF
                            TYDMKYQKNVANMLENILLRHFVLIRPEFFTGSKKVGEGKKITCK
                            ARAQIEIAENGMRSEDFTYKLSDGKKNISTCMIAARDQKYLNTVA
                            RLLYYPHEAKKSIVDTREKKNNKKTNRGDGTFNKQKGTARKEKD
                            NGPREFNDTGFSNTPFAGFDPFRNS (SEQ ID NO: 61)

c2c2-8  5  Carnobacterium   MRITKVKIKLDNKLYQVTMQKEEKYGTLKLNEESRKSTAEILRLK
           gallinarum       KASFNKSFHSKTINSQKENKNATIKKNGDYISQIFEKLVGVDTNKNI
           DSM 4847         RKPKMSLTDLKDLPKKDLALFIKRKFKNDDIVEIKNLDLISLFYNA
                            LQKVPGEHFTDESWADFCQEMMPYREYKNKFIERKIILLANSIEQN
                            KGFSINPETFSKRKRVLHQWAIEVQERGDFSILDEKLSKLAEIYNFK
                            KMCKRVQDELNDLEKSMKKGKNPEKEKEAYKKQKNFIKTIWK
                            DYPYKTHIGLIEKIKENEELNQFNIEIGKYFEHYFPIKKERCTEDEPY
                            YLNSETIATTVNYQLKNALISYLMQIGKYKQFGLENQVLDSKKLQ
```

-continued

|  |  |  |  |
|---|---|---|---|
| | | | EIGIYEGFQTKFMDACVFATSSLKNIIEPMRSGDILGKREFKEAIATS<br>SFVNYHHFFPYFPFELKGMKDRESELIPFGEQTEAKQMQNIWALR<br>GSVQQIRNEIFHSFDKNQKFNLPQLDKSNFEFDASENSTGKSQSYIE<br>TDYKFLFEAEKNQLEQFFIERIKSSGALEYYPLKSLEKLFAKKEMK<br>FSLGSQVVAFAPSYKKLVKKGHSYQTATEGTANYLGLSYYNRYEL<br>KEESFQAQYYLLKLIYQYVFLPNFSQGNSPAFRETVKAILRINKDE<br>ARKKMKKNKKFLRKYAFEQVREMEFKETPDQYMSYLQSEMREE<br>KVRKAEKNDKGFEKNITMNFEKLLMQIFVKGFDVFLTTFAGKELL<br>LSSEEKVIKETEISLSKKINEREKTLKASIQVEHQLVATNSAISYWLF<br>CKLLDSRHLNELRNEMIKFKQSRIKFNHTQHAELIQNLLPIVELTILS<br>NDYDEKNDSQNVDVSAYFEDKSLYETAPYVQTDDRTRVSFRPILK<br>LEKYHTKSLIEALLKDNPQFRVAATDIQEWMHKREEIGELVEKRK<br>NLHTEWAEGQQTLGAEKREEYRDYCKKIDRFNWKANKVTLTYLS<br>QLHYLITDLLGRMVGFSALFERDLVYFSRSFSELGGETYHISDYKN<br>LSGVLRLNAEVKPIKIKNIKVIDNEENPYKGNEPEVKPFLDRLHAY<br>LENVIGIKAVHGKIRNQTAHLSVLQLELSMIESMNNLRDLMAYDR<br>KLKNAVTKSMIKILDKHGMILKLKIDENHKNFEIESLIPKEIIHLKDK<br>AIKTNQVSEEYCQLVLALLTTNPGNQLN (SEQ ID NO: 62) |
| c2c2-9 | 6 | Carnobacterium<br>gallinarum<br>DSM 4847 | MRMTKVKINGSPVSMNRSKLNGHLVWNGTTNTVNILTKKEQSFA<br>ASFLNKTLVKADQVKGYKVLAENIFIIFEQLEKSNSEKPSVYLNNIR<br>RLKEAGLKRFFKSKYHEEIKYTSEKNQSVPTKLNLIPLFFNAVDRIQ<br>EDKFDEKNWSYFCKEMSPYLDYKKSYLNRKKEILANSIQQNRGFS<br>MPTAEEPNLLSKRKQLFQQWAMKFQESPLIQQNNPFAVEQFNKEFA<br>NKINELAAVYNVDELCTAITEKLMNFDKDKSNKTRNFEIKKLWKQ<br>HPHNKDKALIKLFNQEGNEALNQFNIELGKYFEHYFPKTGKKESA<br>ESYYLNPQTIIKTVGYQLRNAFVQYLLQVGKLHQYNKGVLDSQTL<br>QEIGMYEGFQTKFMDACVFASSSLRNIIQATTNEDILTREKFKKELE<br>KNVELKHDLFFKTEIVEERDENPAKKIAMTPNELDLWAIRGAVQR<br>VRNQIFHQQINKRHEPNQLKVGSFENGDLGNVSYQKTIYQKLFDA<br>EIKDIEIYFAEKIKSSGALEQYSMKDLEKLFSNKELTLSLGGQVVAF<br>APSYKKLYKQGYFYQNEKTIELEQFTDYDFSNDVFKANYYLIKLIY<br>HYVFLPQFSQANNKLFKDTVHYVIQQNKELNTTEKDKKNNKKIRK<br>YAFEQVKLMKNESPEKYMQYLQREMQEERTIKEAKKTNEEKPNY<br>NFEKLLIQIFIKGFDTFLRNFDLNLNPAEELVGTVKEKAEGLRKRKE<br>RIAKILNVDEQIKTGDEEIAFWIFAKLLDARHLSELRNEMIKFKQSS<br>VKKGLIKNGDLIEQMQPILELCILSNDSESMEKESFDKIEVFLEKVE<br>LAKNEPYMQEDKLTPVKFRFMKQLEKYQTRNFIENLVIENPEFKVS<br>EKIVLNWHEEKEKIADLVDKRTKLHEEWASKAREIEEYNEKIKKN<br>KSKKLDKPAEFAKFAEYKIICEAIENFNRLDHKVRLTYLKNLHYLM<br>IDLMGRMVGFSVLFERDFVYMGRSYSALKKQSIYLNDYDTFANIR<br>DWEVNENKHLFGTSSSDLTFQETAEFKNLKKPMENQLKALLGVT<br>NHSFEIRNNIAHLHVLRNDGKGEGVSLLSCMNDLRKLMSYDRKLK<br>NAVTKAIIKILDKHGMILKLTNNDHTKPFEIESLKPKKIIHLEKSNHS<br>FPMDQVSQEYCDLVKKMLVFTN (SEQ ID NO: 63) |
| c2c2-<br>10 | 7 | Paludibacter<br>propionicigenes<br>WB4 | MRVSKVKVKDGGKDKMVLVHRKTTGAQLVYSGQPVSNETSNILP<br>EKKRQSFDLSTLNKTIIKFDTAKKQKLNVDQYKIVEKIFKYPKQEL<br>PKQIKAEEILPFLNHKFQEPVKYWKNGKEESFNLTLLIVEAVQAQD<br>KRKLQPYYDWKTWYIQTKSDLLKKSIENNRIDLTENLSKRKKALL<br>AWETEFTASGSIDLTHYHKVYMTDVLCKMLQDVKPLTDDKGKIN<br>TNAYHRGLKKALQNHQPAIFGTREVPNEANRADNQLSIYHLEVVK<br>YLEHYFPIKTSKRRNTADDIAHYLKAQTLKTTIEKQLVNAIRANIIQ<br>QGKTNHHELKADTTSNDLIRIKTNEAFVLNLTGTCAFAANNIRNM<br>VDNEQTNDILGKGDFIKSLLKDNTNSQLYSFFFGEGLSTNKAEKET<br>QLWGIRGAVQQIRNNVNHYKKDALKTVFNISNFENPTITDPKQQT<br>NYADTIYKARFINELEKIPEAFAQQLKTGGAVSYYTIENLKSLLTTF<br>QFSLCRSTIPFAPGFKKVFNGGINYQNAKQDESFYELMLEQYLRKE<br>NFAEESYNARYFMLKLIYNNLFLPGFTTDRKAFADSVGFVQMQNK<br>KQAEKVNPRKKEAYAFEAVRPMTAADSIADYMAYVQSELMQEQ<br>NKKEEKVAEETRINFEKFVLQVFIKGFDSFLRAKEFDFVQMPQPQL<br>TATASNQQKADKLNQLEASITADCKLTPQYAKADDATHIAFYVFC<br>KLLDAAHLSNLRNELIKFRESVNEFKFHHLLEIIEICLLSADVVPTD<br>YRDLYSSEADCLARLRPFIEQGADITNWSDLFVQSDKHSPVIHANIE<br>LSVKYGTTKLLEQIINKDTQFKTTEANFTAWNTAQKSIEQLIKQRE<br>DHHEQWVKAKNADDKEKQERKREKSNFAQKFIEKHGDDYLDICD<br>YINTYNWLDNKMHFVHLNRLHGLTIELLGRMAGFVALFDRDFQFF<br>DEQQIADEFKLHGFVNLHSIDKKLNEVPTKKIKEIYDIRNKIIQINGN<br>KINESVRANLIQFISSKRNYYNNAFLHVSNDEIKEKQMYDIRNHIA<br>HFNYLTKDAADFSLIDLINELRELLHYDRKLKNAVSKAFIDLFDKH<br>GMILKLKLNADHKLKVESLEPKKIYHLGSSAKDKPEYQYCTNQV<br>MMAYCNMCRSLLEMKK (SEQ ID NO: 64) |
| c2c2-<br>11 | 9 | Listeria<br>weihenstephanensis<br>FSL<br>R9-0317 | MLALLHQEVPSQKLHNLKSLNTESLTKLFKPKFQNMISYPPSKGAE<br>HVQFCLTDIAVPAIRDLDEIKPDWGIFFEKLKPYTDWAESYIHYKQ<br>TTIQKSIEQNKIQSPDSPRKLVLQKYVTAFLNGEPLGLDLVAKKYK<br>LADLAESFKVVDLNEDKSANYKIKACLQQHQRNILDELKEDPELN<br>QYGIEVKKYIQRYFPIKRAPNRSKHARADFLKKELIESTVEQQFKN<br>AVYHYVLEQGKMEAYELTDPKTKDLQDIRSGEAFSFKFINACAFA<br>SNNLKMILNPECEKDILGKGDFKKNLPNSTTQSDVVKKMIPFFSDEI<br>QNVNFDEAIWAIRGSIQQIRNEVYHCKKHSWKSILKIKGFEFEPNN |

-continued

| | | |
|---|---|---|
| | | MKYTDSDMQKLMDKDIAKIPDFIEEKLKSSGIIRFYSHDKLQSIWE<br>MKQGFSLLTTNAPFVPSFKRVYAKGHDYQTSKNRYYDLGLTTFDI<br>LEYGEEDFRARYFLTKLVYYQQFMPWFTADNNAFRDAANFVLRL<br>NKNRQQDAKAFINIREVEEGEMPRDYMGYVQGQIAIHEDSTEDTP<br>NHFEKFISQVFIKGFDSHMRSADLKFIKNPRNQGLEQSEIEEMSFDI<br>KVEPSFLKNKDDYIAFWTFCKMLDARHLSELRNEMIKYDGHLTGE<br>QEIIGLALLGVDSRENDWKQFFSSEREYEKIMKGYVGEELYQREPY<br>RQSDGKTPILFRGVEQARKYGTETVIQRLFDASPEFKVSKCNITEW<br>ERQKETIEETIERRKELHNEWEKNPKKPQNNAFFKEYKECCDAIDA<br>YNWHKNKTTLVYVNELHHLLIEILGRYVGYVAIADRDFQCMANQ<br>YFKHSGITERVEYWGDNRLKSIKKLDTFLKKEGLFVSEKNARNHIA<br>HLNYLSLKSECTLLYLSERLREIFKYDRKLKNAVSKSLIDILDRHG<br>MSVVFANLKENKFSRLVIKSLEPKKLRHLGEKKIDNGYIETNQVSEE<br>YCGIVKRLLEI (SEQ ID NO: 65) |
| c2c2-12 | 10 Listeriaceae bacterium FSL M6-0635 = Listeria newyorkensis FSL M6-0635 | MKITKMRVDGRTIVMERTSKEGQLGYEGIDGNKTTEIIFDKKKESF<br>YKSILNKTVRKPDEKEKNRRKQAINKAINKEITELMLAVLHQEVPS<br>QKLHNLKSLNTESLTKLFKPKFQNMISYPPSKGAEHVQFCLTDIAV<br>PAIRDLDEIKPDWGIFFEKLKPYTDWAESYIHYKQTTIQKSIEQNKI<br>QSPDSPRKLVLQKYVTAFLNGEPLGLDLVAKKYKLADLAESFKLV<br>DLNEDKSANYKIKACLQQHQRNILDELKEDPELNQYGIEVKKYIQ<br>RYFPIKRAPNRSKHARADFLKKELIESTVEQQFKNAVYHYVLEQG<br>KMEAYELTDPKTKDLQDIRSGEAFSFKFINACAFASNNLKMILNPE<br>CEKDILGKGNFKKNLPNSTTRSDVVKKMIPFFSDELQNVNFDEAIW<br>AIRGSIQQIRNEVYHCKKHSWKSILKIKGFEFEPNNMKYADSDMQ<br>KLMDKDIAKIPEFIEEKLKSSGVVRFYRHDELQSIWEMKQGFSLLT<br>TNAPFVPSFKRVYAKGHDYQTSKNRYYNLDLTTFDILEYGEEDFR<br>ARYFLTKLVYYQQFMPWFTADNNAFRDAANFVLRLNKNRQQDA<br>KAFINIREVEEGEMPRDYMGYVQGQIAIHEDSIEDTPNHFEKFISQV<br>FIKGFDRHMRSANLKFIKNPRNQGLEQSEIEEMSFDIKVEPSFLKNK<br>DDYIAFWIFCKMLDARHLSELRNEMIKYDGHLTGEQEIIGLALLGV<br>DSRENDWKQFFSSEREYEKIMKGYVVEELYQREPYRQSDGKTPILF<br>RGVEQARKYGTETVIQRLFDANPEFKVSKCNLAEWERQKETIEETI<br>KRRKELHNEWAKNPKKPQNNAFFKEYKECCDAIDAYNWHKNKT<br>TLAYVNELHHLLIEILGRYVGYVAIADRDFQCMANQYFKHSGITER<br>VEYWGDNRLKSIKKLDTFLKKEGLFVSEKNARNHIAHLNYLSLKS<br>ECTLLYLSERLREIFKYDRKLKNAVSKSLIDILDRHGMSVVFANLK<br>ENKHRLVIKSLEPKKLRHLGGKKIDGGYIETNQVSEEYCGIVKRLL<br>EM (SEQ ID NO: 66) |
| c2c2-13 | 12 Leptotrichia wadei F0279 | MKVTKVDGISHKKYIEEGKLVKSTSEENRTSERLSELLSIRLDIYIK<br>NPDNASEEENRIRRENLKKFFSNKVLHLKDSVLYLKNRKEKNAVQ<br>DKNYSEEDISEYDLKNKNSFSVLKKILLNEDVNSEELEIFRKDVEA<br>KLNKINSLKYSFEENKANYQKINENNVEKVGGKSKRNIIYDYYRES<br>AKRNDYINNVQEAFDKLYKKEDIEKLFFLIENSKKHEKYKIREYYH<br>KIIGRKNDKENFAKIIYEEIQNVNNIKELIEKIPDMSELKKSQVFYKY<br>YLDKEELNDKNIKYAFCHFVEIEMSQLLKNYVYKRLSNISNDKIKR<br>IFEYQNLKKLIENKLLNKLDTYVRNCGKYNYYLQVGEIATSDFIAR<br>NRQNEAFLRNIIGVSSVAYFSLRNILETENENDITGRMRGKTVKNN<br>KGEEKYVSGEVDKIYNENKQNEVKENLKMFYSYDFNMDNKNEIE<br>DFFANIDEAISSIRHGIVHFNLELEGKDIFAFKNIAPSEISKKMFQNEI<br>NEKKLKLKIFKQLNSANVFNYYEKDVIIKYLKNTKFNFVNKNIPFV<br>PSFTKLYNKIEDLRNTLKFFWSVPKDKEEKDAQIYLLKNIYYGEFL<br>NKFVKNSKVFFKITNEVIKINKQRNQKTGHYKYQKFENIEKTVPVE<br>YLAIIQSREMINNQDKEEKNTYIDFIQQIFLKGFIDYLNKNNLKYIES<br>NNNNDNNDIFSKIKIKKDNKEKYDKILKNYEKHNRNKEIPHEINEF<br>VREIKLGKILKYTENLNMFYLILKLLNHKELTNLKGSLEKYQSANK<br>EETFSDELELINLLNLDNNRVTEDFELEANEIGKFLDFNENKIKDRK<br>ELKKFDTNKIYFDGENIIKHRAFYNIKKYGMLNLLEKIADKAKYKI<br>SLKELKEYSNKKNEIEKNYTMQQNLHRKYARPKKDEKFNDEDYK<br>EYEKAIGNIQKYTHLKNKVEFNELNLLQGLLLKILHRLVGYTSIWE<br>RDLRFRLKGEFPENHYIEEIFNFDNSKNVKYKSGQIVEKYINFYKEL<br>YKDNVEKRSIYSDKKVKKLKQEKKDLYIRNYIAHFNYIPHAEISLL<br>EVLENLRKLLSYDRKLKNAIMKSIVDILKEYGFVATFKIGADKKIEI<br>QTLESEKIVHLKNLKKKKLMTDRNSEELCELVKVMFEYKALE (SEQ ID<br>NO: 67) |
| c2c2-14 | 15 Rhodobacter capsulatus SB 1003 | MQIGKVQGRTISEFGDPAGGLKRKISTDGKNRKELPAHLSSDPKAL<br>IGQWISGTDKIYRKPDSRKSDGKAIHSPTPSKMQFDARDDLGEAFW<br>KLVSEAGLAQDSDYDQFKRRLHPYGDKFQPADSGAKLKFEADPPE<br>PQAFHGRWYGAMSKRGNDAKELAAALYEHLHVDEKRIDGQPKR<br>NPKTDKFAPGLVVARALGIESSVLPRGMARLARNWGEEEIQTYFV<br>VDVAASVKEVAKAAVSAAQAFDPPRQVSGRSLSPKVGFALAEHL<br>ERVTGSKRCSFDPAAGPSVLALHDEVKKTYKRLCARGKNAARAFP<br>ADKTELLALMRHTHENRVRNQMVRMGRVSEYRGQQAGDLAQSH<br>YWTSAGQTEIKESEIFVRLWVGAFALAGRSMKAWIDPMGKIVNTE<br>KNDRDLTAAVNIRQVISNKEMVAEAMARRGIYFGETPELDRLGAE<br>GNEGFVFALLRYLRGCRNQTFHLGARAGFLKEIRKELEKTRWGKA<br>KEAEHVVLTDKTVAAIRAIIDNDAKALGARLLADLSGAFVAHYAS<br>KEHFSTLYSEIVKAVKDAPEVSSGLPRLKLLLKRADGVRGYVHGL<br>RDTRKHAFATKLPPPPAPRELDDPATKARYIALLRLYDGPFRAYAS |

|         |                                  |                                                                                                                                                                                                                                                                                                                                                                                                                                                                                                                                                                                                                                                                                                                                                                                                                                                                                                                                                                                                                                                                                                                                                                                                   |
|---------|----------------------------------|---------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------------|
|         |                                  | -continued<br>GITGTALALAGPAARAKEAATALAQSVNVTKAYSDVMEGRTSRLPPP<br>NDGETLREYLSALTGETATEFRVQIGYESDSENARKQAEFIENYRR<br>DMLAFMFEDYIRAKGFDWILKIEPGATAMTRAPVLPEPIDTRGQYE<br>HWQAALYLVMHFVPASDVSNLLHQLRKWEALQGKYELVQDGDA<br>TDQADARREALDLVKRFRDVLVLFLKTGEARFEGRAAPFDLKPFR<br>ALFANPATFDRLFMATPTTARPAEDDPEGDGASEPELRVARTLRG<br>LRQIARYNHMAVLSDLFAKHKVRDEEVARLAEIEDETQEKSQIVA<br>AQELRTDLHDKVMKCHPKTISPEERQSYAAAIKTIEEHRFLVGRVY<br>LGDHLRLHRLMMDVIGRLIDYAGAYERDTGTFLINASKQLGAGAD<br>WAVTIAGAANTDARTQTRKDLAHFNVLDRADGTPDLTALVNRAR<br>EMMAYDRKRKNAVPRSILDMLARLGLTLKWQMKDHLLQDATIT<br>QAAIKHLDKVRLTVGGPAAVTEARFSQDYLQMVAAVFNGSVQNP<br>KPRRRDDGDAWHKPPKPATAQSQPDQKPPNKAPSAGSRLPPPQVG<br>EVYEGVVVKVIDTGSLGFLAVEGVAGNIGLHISRLRRIREDAIIVGR<br>RYRFRVEIYVPPKSNTSKLNAADLVRID (SEQ ID NO: 68)                                                                                                                                                                                                                                                                                                                                                                                                                                                   |
| c2c2-15 | 16 Rhodobacter capsulatus R121   | MQIGKVQGRTISEFGDPAGGLKRKISTDGKNRKELPAHLSSDPKAL<br>IGQWISGIDKIYRKPDSRKSDGKAIHSPTPSKMQFDARDDLGEAFW<br>KLVSEAGLAQDSDYDQFKRRLHPYGDKFQPADSGAKLKFEADPPE<br>PQAFHGRWYGAMSKRGNDAKELAAALYEHLFHDEKRIDGQPKR<br>NPKTDKFAPGLVVARALGIESSVLPRGMARLARNWGEEEIQTYFV<br>VDVAASVKEVAKAAVSAAQAFDPPRQVSGRSLSPKVGFALAEHL<br>ERVTGSKRCSFDPAAGPSVLALHDEVKKTYKRLCARGKNAARAFP<br>ADKTELLALMRHTHENRVRNQMVRMGRVSEYRGQQAGDLAQSH<br>YWTSAGQTEIKESEIFVRLWVGAFALAGRSMKAWIDPMGKIVNTE<br>KNDRDLTAAVNIRQVISNKEMVAEAMARRGIYFGETPELDRLGAE<br>GNEGFVFALLRYLRGCRNQTFHLGARAGFLKEIRKELEKTRWGKA<br>KEAEHVVLTDKTVAAIRAIIDNDAKALGARLLADLSGAFVAHYAS<br>KEHFSTLYSEIVKAVKDAPEVSSGLPRLKLLLKRADGVRGYVHGL<br>RDTRKHAFATKLPPPPAPRELDDPATKARYIALLRLYDGPFRAYAS<br>GITGTALAGPAARAKEAATALAQSVNVTKAYSDVMEGRSSRLPPP<br>NDGETLREYLSALTGETATEFRVQIGYESDSENARKQAEFIENYRR<br>DMLAFMFEDYIRAKGFDWILKIEPGATAMTRAPVLPEPIDTRGQYE<br>HWQAALYLVMHFVPASDVSNLLHQLRKWEALQGKYELVQDGDA<br>TDQADARREALDLVKRFRDVLVLFLKTGEARFEGRAAPFDLKPFR<br>ALFANPATFDRLFMATPTTARPAEDDPEGDGASEPELRVARTLRG<br>LRQIARYNHMAVLSDLFAKHKVRDEEVARLAEIEDETQEKSQIVA<br>AQELRTDLHDKVMKCHPKTISPEERQSYAAAIKTIEEHRFLVGRVY<br>LGDHLRLHRLMMDVIGRLIDYAGAYERDTGTFLINASKQLGAGAD<br>WAVTIAGAANTDARTQTRKDLAHFNVLDRADGTPDLTALVNRAR<br>EMMAYDRKRKNAVPRSILDMLARLGLTLKWQMKDHLLQDATIT |
|         |                                  | QAAIKHLDKVRLTVGGPAAVTEARFSQDYLQMVAAVFNGSVQNP<br>KPRRRDDGDAWHKPPKPATAQSQPDQKPPNKAPSAGSRLPPPQVG<br>EVYEGVVVKVIDTGSLGFLAVEGVAGNIGLHISRLRRIREDAIIVGR<br>RYRFRVEIYVPPKSNTSKLNAADLVRID (SEQ ID NO: 69)                                                                                                                                                                                                                                                                                                                                                                                                                                                                                                                                                                                                                                                                                                                                                                                                                                                                                                                                                                                                    |
| c2c2-16 | 17 Rhodobacter capsulatus DE442  | MQIGKVQGRTISEFGDPAGGLKRKISTDGKNRKELPAHLSSDPKAL<br>IGQWISGIDKIYRKPDSRKSDGKAIHSPTPSKMQFDARDDLGEAFW<br>KLVSEAGLAQDSDYDQFKRRLHPYGDKFQPADSGAKLKFEADPPE<br>PQAFHGRWYGAMSKRGNDAKELAAALYEHLHVDEKRIDGQPKR<br>NPKTDKFAPGLVVARALGIESSVLPRGMARLARNWGEEEIQTYFV<br>VDVAASVKEVAKAAVSAAQAFDPPRQVSGRSLSPKVGFALAEHL<br>ERVTGSKRCSFDPAAGPSVLALHDEVKKTYKRLCARGKNAARAFP<br>ADKTELLALMRHTHENRVRNQMVRMGRVSEYRGQQAGDLAQSH<br>YWTSAGQTEIKFSEIFVRLWVGAFALAGRSMKAWIDPMGKIVNTE<br>KNDRDLTAAVNIROVISNKEMVAEAMARRGIYFGETPELDRLGAE<br>GNEGFVFALLRYLRGCRNQTFHLGARAGFLKEIRKELEKTRWGKA<br>KEAEHVVLTDKTVAAIRAIIDNDAKALGARLLADLSGAFVAHYAS<br>KEHFSTLYSEIVKAVKDAPEVSSGLPRLKLLLLKRADGVRGYVHGL<br>RDTRKHAFATKLPPPPAPRELDDPATKARYIALLRLYDGPFRAYAS<br>GITGTALAGPAARAKEAATALAQSVNVTKAYSDVMEGRSSRLPPP<br>NDGETLREYLSALTGETATEFRVQIGYESDSENARKQAEFIENYRR<br>DMLAFMFEDYIRAKGFDWILKIEPGATAMTRAPVLPEPIDTRGQYE<br>HWQAALYLVMHFVPASDVSNLLHQLRKWEALQGKYELVQDGDA<br>TDQADARREALDLVKRFRDVLVLFLKTGEARFEGRAAPFDLKPFR<br>ALFANPATFDRLFMATPTTARPAEDDPEGDGASEPELRVARTLRG<br>LRQIARYNFTMAVLSDLFAKHKVRDEEVARLAEIEDETQEKSQIVA<br>AQELRTDLHDKVMKCHPKTISPEERQSYAAAIKTIEEHRFLVGRVY<br>LGDHLRLHRLMMDVIGRLIDYAGAYERDTGTFLINASKQLGAGAD<br>WAVTIAGAANTDARTQTRKDLAHFNVLDRADGTPDLTALVNRAR                                 |
|         |                                  | EMMAYDRKRKNAVPRSILDMLARLGLTLKWQMKDHLLQDATIT<br>OAAIKHLDKVRLTVGGPAAVTEARFSQDYLQMVAAVFNGSVQNP<br>KPRRRDDGDAWHKPPKPATAQSQPDQKPPNKAPSAGSRLPPPQVG<br>EVYEGVVVKVIDTGSLGFLAVEGVAGNIGLHISRLRRIREDAIIVGR<br>RYRFRVEIYVPPKSNTSKLNAADLVRID (SEQ ID NO: 70)                                                                                                                                                                                                                                                                                                                                                                                                                                                                                                                                                                                                                                                                                                                                                                                                                                                                                                                                                      |
| c2c2-2  |                                  | MGNLFGHKRWYEVRDKKDFKIKRKVKVKRNYDGNKYILNINENN<br>NKEKIDNNKFIRKYINYKKNDNILKEFTRKFHAGNILFKLKGKEGII<br>RIENNDDFLETEEVVLYIEAYGKSEKLKALGITKKKIIDEAIRQGITK<br>DDKKIEIKRQENEEEIEIDIRDEYTNKTLNDCSIILRIIENDELETKKSI<br>YEIFKNINMSLYKIIEKIIENETEKVFENRYYEEHLREKLLKDDKIDV                                                                                                                                                                                                                                                                                                                                                                                                                                                                                                                                                                                                                                                                                                                                                                                                                                                                                                                                         |

-continued

```
              ILTNFMEIREKIKSNLEILGFVKFYLNVGGDKKKSKNKKMLVEKIL
              NINVDLTVEDLADFVIKELEFWNITKRIEKVKKVNNEFLEKRRNRT
              YIKSYVLLDKHEKFKIERENKKDKIVKFFVENIKNNSIKEKIEKILAE
              FKIDELIKKLEKELKKGNCDTEIFGIFKKHYKVNFDSKKFSKKSDEE
              KELYKIIYRYLKGRIEKILVNEQKVRLKKMEKIEIEKILNESILSEKIL
              KRVKQYTLEHIMYLGKLRHNDIDMTTVNTDDFSRLHAKEELDLEL
              ITFFASTNMELNKIFSRENINNDENIDFFGGDREKNYVLDKKILNSK
              IKIIRDLDFIDNKNNITNNFIRKFTKIGTNERNRILHAISKERDLQGTQ
              DDYNKVINIIQNLKISDEEVSKALNLDVVFKDKKNIITKINDIKISEE
              NNNDIKYLPSFSKVLPEILNLYRNNPKNEPFDTIETEKIVLNALIYVN
              KELYKKLILEDDLEENESKNIFLQELKKTLGNIDEIDENIIENYYKN
              AQISASKGNNKAIKKYQKKVIECYIGYLRKNYEELFDFSDFKMNIQ
              EIKKQIKDINDNKTYERITVKTSDKTIVINDDFEYIISIFALLNSNAVI
              NKIRNRFFATSVWLNTSEYQNIIDILDEIMQLNTLRNECITENWNLN
              LEEFIQKMKEIEKDFDDFKIQTKKEIFNNYYEDIKNNILTEFKDDIN
              GCDVLEKKLEKIVIFDDETKFEIDKKSNILQDEQRKLSNINKKDLKK
              KVDQYIKDKDQEIKSKILCRIIFNSDFLKKYKKEIDNLIEDMESENE
              NKFQEIYYPKERKNELYIYKKNLFLNIGNPNFDKIYGLISNDIKMAD
              AKFLFNIDGKNIRKNKISEIDAILKNLNDKLNGYSKEYKEKYIKKLK
              ENDDFFAKNIQNKNYKSFEKDYNRVSEYKKIRDLVEFNYLNKIESY
              LIDINWKLAIQMARFERDMHYIVNGLRELGIIKLSGYNTGISRAYPK
              RNGSDGFYTTTAYYKFFDEESYKKFEKICYGFGIDLSENSEINKPEN
              ESIRNYISHFYIVKNPFADYSIAEQIDRVSNLLSYSTRYNNSTYASVF
              EVFKKDVNLDYDELKKKFKLIGNNDILERLMKPKKVSVLELESYN
              SDYIKNLIIELLTKIENTNDTL (SEQ ID NO: 71)

c2c2-3   L wadei      MKVTKVDGISHKKYIEEGKLVKSTSEENRTSERLSELLSIRLDIYIK
         (Lw2)        NPDNASEEENRIRRENLKKFFSNKVLHLKDSVLYLKNRKEKNAVQ
                      DKNYSEEDISEYDLKNKNSFSVLKKILLNEDVNSEELEIFRKDVEA
                      KLNKINSLKYSFEENKANYQKINENNVEKVGGKSKRNIIYDYYRES
                      AKRNDYINNVQEAFDKLYKKEDIEKLFFLIENSKKHEKYKIREYYH
                      KIIGRKNDKENFAKIIYEEIQNVNNIKELIEKIPDMSELKKSQVPFYKY
                      YLDKEELNDKNIKYAFCHFVEIEMSQLLKNYVYKRLSNISNDKIKR
                      IFEYQNLKKLIENKLLNKLDTYVRNCGKYNYYLQVGEIATSDFIAR
                      NRQNEAFLRNIIGVSSVAYFSLRNILETENENDITGRMRGKTVKNN
                      KGEEKYVSGEVDKIYNENKQNEVKENLKMFYSYDFNMDNKNEIE
                      DFFANIDEAISSIRHGIVHFNLELEGKDIFAFKNIAPSEISKKMFQNEI
                      NEKKLKLKIPFKQLNSANVFNYYEKDVIIKYLKNTKFNFVNKNIPFV
                      PSFTKLYNKIEDLRNTLKFFWSVPKDKEEKDAQIYLLKNIYYGEFL
                      NKFVKNSKVFFKITKEVIKINKQRNQKTGHYKYQKFENIEKTVPVE
                      YLAIIQSREMINNQDKEEKNTYIDFIQOIFLKGFIDYLNKNNLKYIES
                      NNNNDNNDIFSKIKIKKDNKEKYDKILKNYEKHNRNKEIPHEINEF
                      VREIKLGKILKYTENLNMFYLILKLLNHKELTNLKGSLEKYQSANK
                      EETFSDELELINLLNLDNNRVTEDFELEANEIGKFLDFNENKIKDRK
                      ELKKFDTNKIYFDGENIIKHRAFYNIKKYGMLNLLEKIADKAKYKI
                      SLKELKEYSNKKNEIEKNYTMQQNLHRKYARPKKDEKFNDEDYK
                      EYEKAIGNIQKYTHLKNKVEFNELNLLQGLLLKILHRLVGYTSIWE
                      RDLRFRLKGEFPENHYIEEIFNFDNSKNVKYKSGQIVEKYINFYKEL
                      YKDNVEKRSIYSDKKVKKLQEKKDLYIRNYIAHFNYIPHAEISLL
                      EVLETMLRKLLSYDRKLKNAIMKSIVDILKEYGFVATFKIGADKKIEI
                      QTLESEKIVHLKNLKKKKLMTDRNSEELCELVKVMFEYKALEKRP
                      AATKKAGQAKKKKGSYPYDVPDYAYPYDVPDYAYPYDVPDYA*
                      (SEQ ID
                      NO: 72)

C2C2-4   Listeria     MWISIKTLIHHLGVLFFCDYMYNRREKKIIEVKTMRITKVEVDRKK
         seeligeri    VLISRDKNGGKLVYENEMQDNTEQIMHHKKSSFYKSVVNKTICRP
                      EQKQMKKLVFSGLLQENSQEKIKVSDVTKLNISNFLNHRFKKSLYY
                      FPENSPDKSEEYRIEINLSQLLEDSLKKQQGTFICWESFSKDMELYI
                      NWAENYISSKTKLIKKSIRNNRIQSTESRSGQLMDRYMKDILNKNK
                      PFDIQSVSEKYQLEKLTSALKATFKEAKKNDKEINYKLKSTLQNHE
                      RQIIEELKENSELNQFNIEIRKHLETYFPIKKTNRKVGDIRNLEIGEIQ
                      KIVNHRLKNKIVQRILQEGKLASYEIESTVNSNSLQKIKIEEAFALKF
                      INACLFASNNLRNMVYPVCKKDILMIGEFKNSFKEIKHKKFIRQWS
                      QFFSQEITVDDIELASWGLRGAIAPIRNEIIHLKKHSWKKFFNNPTF
                      KVKKSKIINGKTKDVTSEFLYKETLFKDYFYSELDSVPELIINKMES
                      SKILDYYSSDQLNQVFTIPNFELSLLTSAVPFAPSFKRVYLKGFDYQ
                      NQDEAQPDYNLKLNIYNEKAFNSEAFQAQYSLFKMVYYQVFLPQF
                      TTNNDLFKSSVDFILTLNKERKGYAKAFQDIRKMNKDEKPSEYMS
                      YIQSQLMLYQKKQEEKEKINHFEKFINQVFIKGFNSFIEKNRLTYIC
                      HPTKNTVPENDNIEIPFHTDMDDSNIAFWLMCKLLDAKQLSELRNE
                      MIKFSCSLQSTEEISTFTKAREVIGLALLNGEKGCNDWKELFDDKE
                      AWKKNMSLYVSEELLQSLPYTQEDGQTPVINRSIDLVKKYGTETIL
                      EKLFSSSDDYKVSAKDIAKLHEYDVTEKIAQQESLHKQWIEKPGLA
                      RDSAWTKKYQNVINDISNYQWAKTKVELTQVRHLHQLTIDLLSRL
                      AGYMSIADRDFQFSSNYILERENSEYRVTSWILLSENKNKNKYND
                      YELYNLKNASIKVSSKNDPQLKVDLKQLRLTLEYLELFDNRLKEK
                      RNNISHFNYLNGQLGNSILELFDDARDVLSYDRKLKNAVSKSLKEI
                      LSSHGMEVTFKPLYQTNHHLKIDKLQPKKIHHLGEKSTVSSNQVSN
                      EYCQLVRTLLTMK (SEQ ID NO: 73)
```

Fusion constructs of each of the C2c2 orthologues with mCherry and optionally NLS or NES were made and cloned in a mammalian expression vector (FIG. 1A). The various C2c2 orthologues were transfected in HEK293T cells and cellular localization was evaluated based on mCherry expression. Representative localizations of different C2c2 orthologues when fused to a C-terminal and N-terminal NES, when fused to a C-terminal and N-terminal NLS, or without NES or NLS fusion are shown in FIGS. 1B, 1C, and 1D, respectively. NES fusions efficiently resulted in cytoplasmic localization of the C2c2 protein. NLS fusions efficiently resulted in nuclear localization of the C2c2 protein. Variably, also nucleolar localization can be observed with NLS fusions. When C2c2 was not fused to an NLS or NES, a variable cytoplasmic/nuclear localization was observed.

Example 3: Activity of C2c2 (Cas13a) in Eukaryotic Cells

Figure 4A:
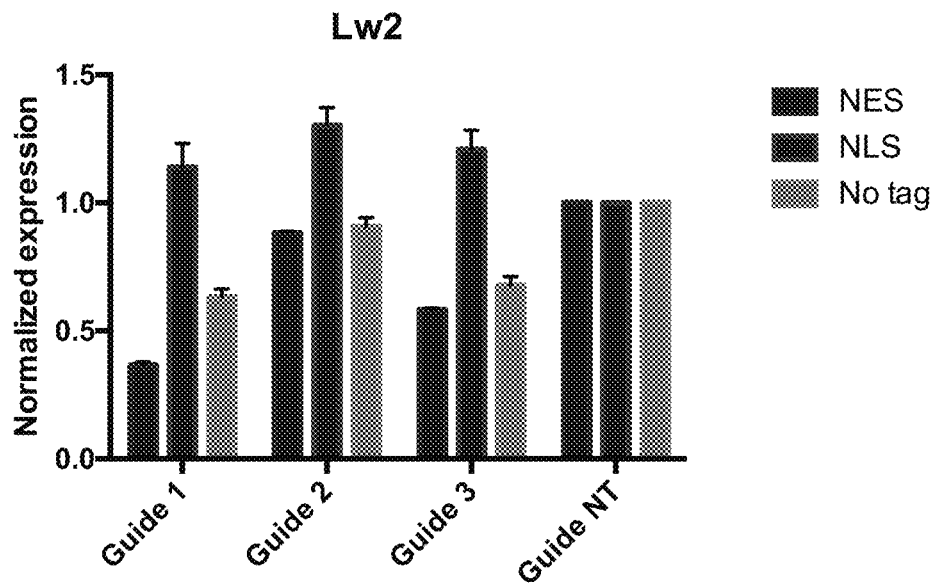
FIG. 4A-4B. Normalized protein expression of luciferase with different gRNAs directed against Gluc and with C2c2 orthologues fused with NLS, NES, or no tag. (A) C2c2 orthologue is *Leptotrichia wadei* F0279 (Lw2). Spacer sequences used in the experiments are (Guide 1) ATCAGGGCAAACAGAACTTTGACTCCCA (SEQ ID NO: 1); (Guide 2) AGATCCGTGGTCGCGAAGTTGCTGGCCA (SEQ ID NO: 2); (Guide 3) TCGCCTTCGTAGGTGTGGCAGCGTCCTG (SEQ ID NO: 3); and (Guide NP) TAGATTGCTGTTCTACCAAGTAATCCAT (SEQ ID NO: 4). (B) C2c2 orthologue is *Listeria newyorkensis* FSL M6-0635 (LbFSL). Spacer sequences used in the experiments are (Guide 1) TCGCCTTCGTAGGTGTGGCAGCGTCCTG (SEQ ID NO: 5) and (Guide NT) tagattgctgttctaccaagtaatccat (SEQ ID NO: 6).
Figure 4B:
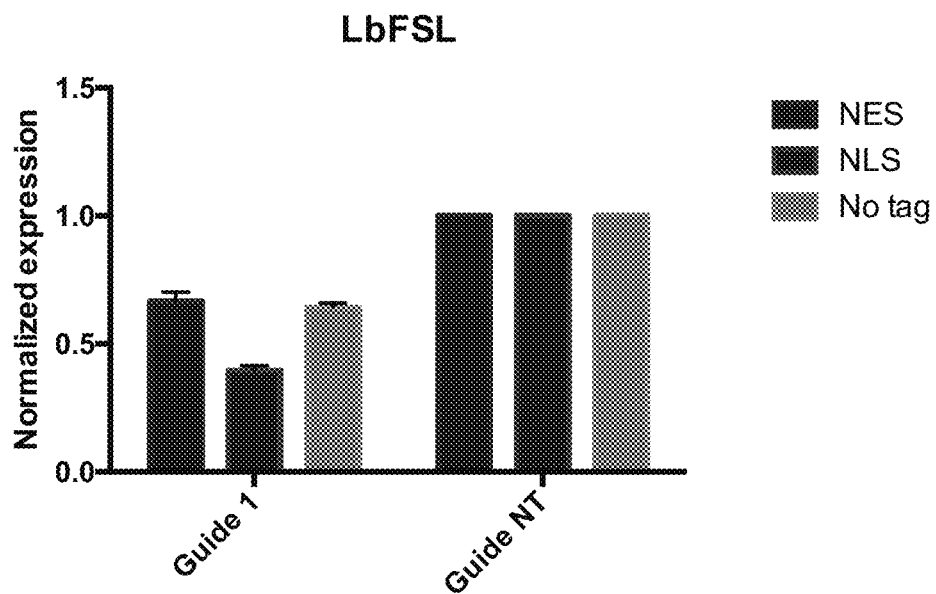

A luciferase targeting assay was performed as indicated in FIG. 2 with different gRNAs directed against Gluc. C2c2 orthologues *Leptotrichia wadei* F0279 (Lw2) and *Listeria newyorkensis* FSL M6-0635 (LbFSL) were fused to an NLS or NES or alternatively were not fused to a localization signal. Normalized protein expression of luciferase was determined and compared to non targeting (NT) gRNA. The results are shown in FIG. 4. Efficient knockdown was apparent. The spacer sequences used in the experiments as depicted in FIGS. 4A and 4B are as follows:
FIG. 4A

```
Guide 1
ATCAGGGCAAACAGAACTTTGACTCCca  (SEQ ID
NO: 1)

Guide 2
AGATCCGTGGTCGCGAAGTTGCTGGCCA  (SEQ ID
NO: 2)

Guide 3
TCGCCTTCGTAGGTGTGGCAGCGTCCTG  (SEQ ID
NO: 3)

Guide NT
tagattgctgactaccaagtaatecat
(SEQ ID NO: 4)
```

FIG. 4B

```
Guide 1
TCGCCTTCGTAGGTGTGGCAGCGTCCTG  (SEQ ID
NO: 5)

Guide NT
tagattgctgttctaccaagtaatccat  (SEQ ID
NO: 6)
```

Figure 5A:
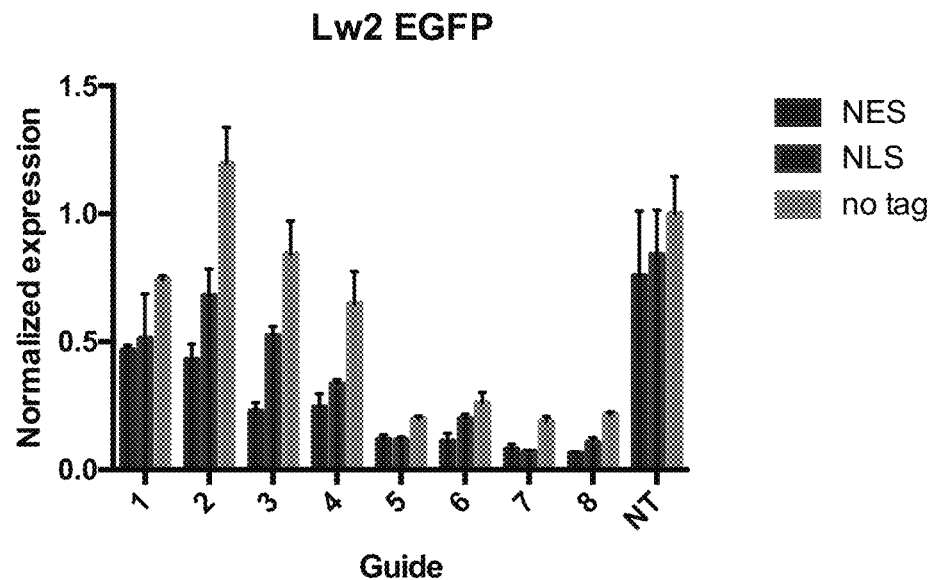
FIG. 5A-5B. Normalized protein expression of GFP with different gRNAs directed against EGFP and with C2c2 orthologues fused with NLS, NES, or no tag. (A) C2c2 orthologues is *Leptotrichia wadei* F0279 (Lw2). Spacer sequences used in the experiments are (Guide 1) tgaacagctcctcgcccttgctcaccat (SEQ ID NO: 7); (Guide 2) tcagcttgccgtaggtggcatcgccctc (SEQ ID NO: 8); (Guide 3) gggtagcggctgaagcactgcacgccgt (SEQ ID NO: 9); (Guide 4) ggtcttgtagttgccgtcgtccttgaag (SEQ ID NO: 10); (Guide 5) tactccagcttgtgccccaggatgttgc (SEQ ID NO: 11); (Guide 6) cacgctgccgtcctcgatgttgtggcgg (SEQ ID NO: 12); (Guide 7) tctttgctcagggcggactgggtgctca (SEQ ID NO: 13); (Guide 8) gacttgtacagctcgtccatgccgagag (SEQ ID NO: 14); and (Guide NT) tagattgctgttctaccaagtaatccat (SEQ ID NO: 6). (B) C2c2 orthologues is *Listeria newyorkensis* FSL M6-0635 (LbFSL). Spacer sequences used in the experiments are (Guide 2) tcagcttgccgtaggtggcatcgccctc (SEQ ID NO: 8); (Guide 3) gggtagcggctgaagcactgcacgccgt (SEQ ID NO: 9)
Figure 5B:
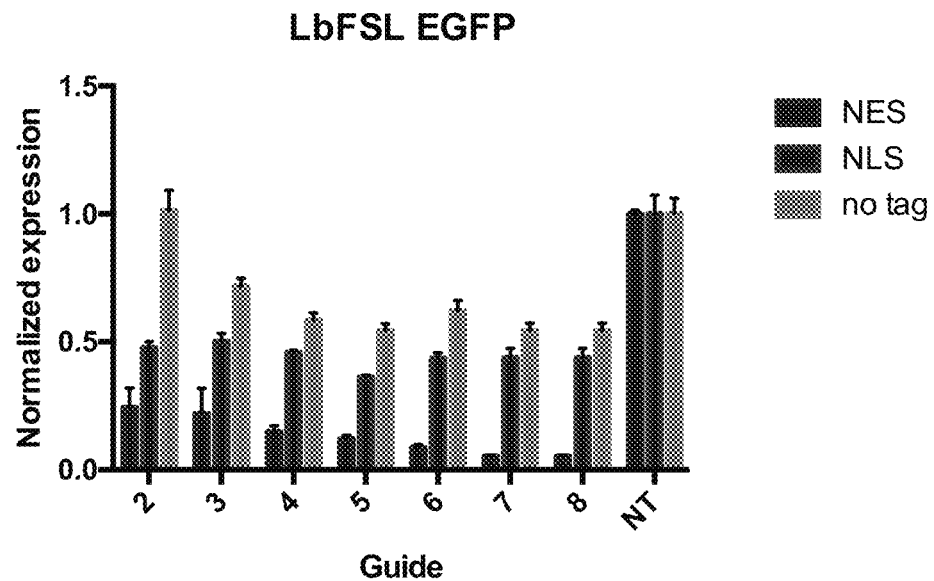
Figure 6A:
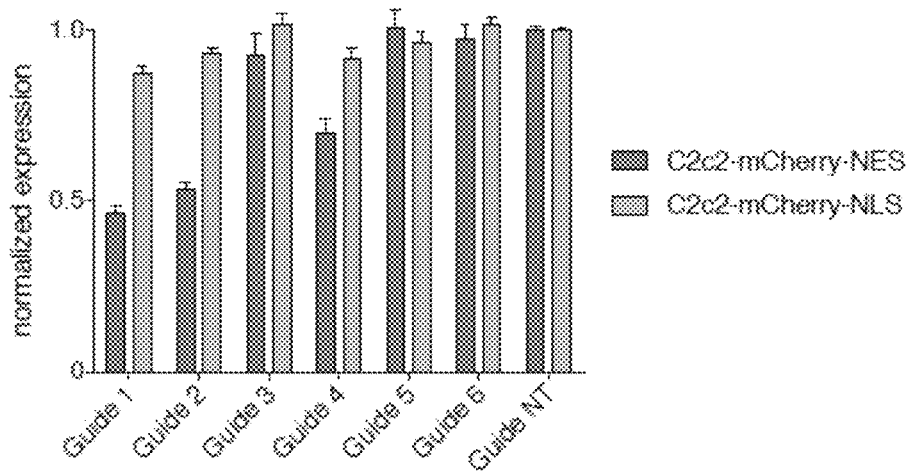
Figure 6B:
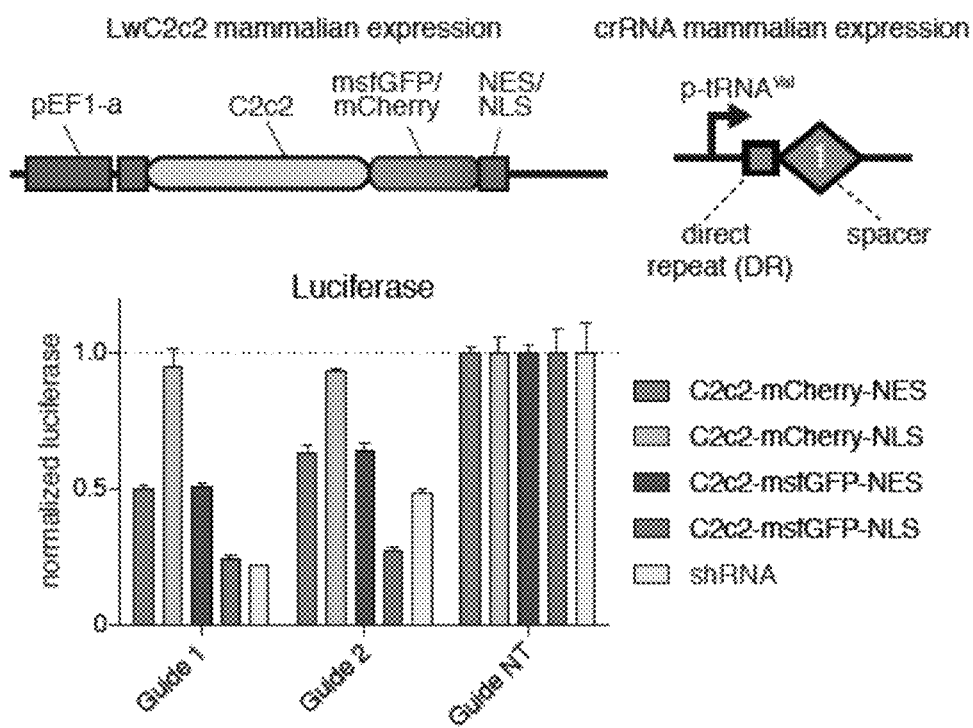
Figure 6C:
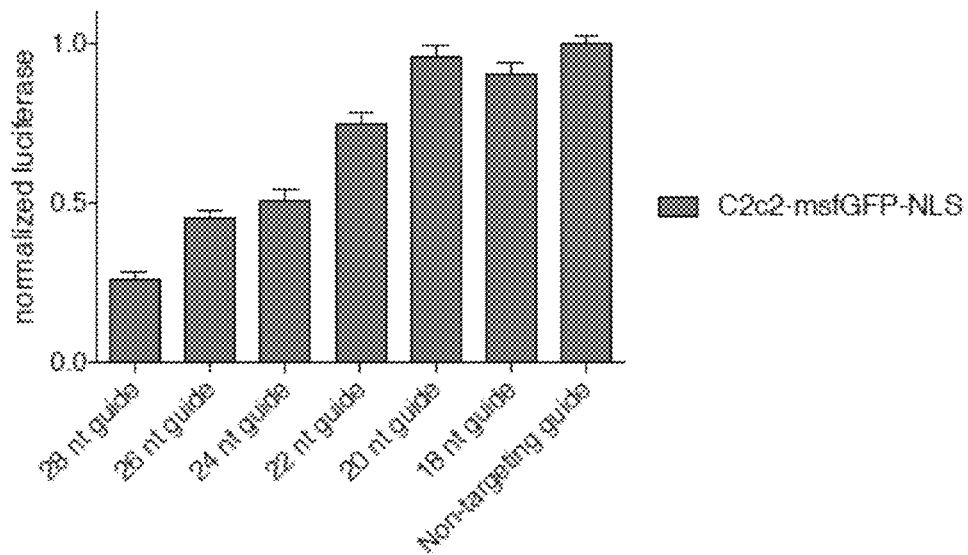
Figure 6D:
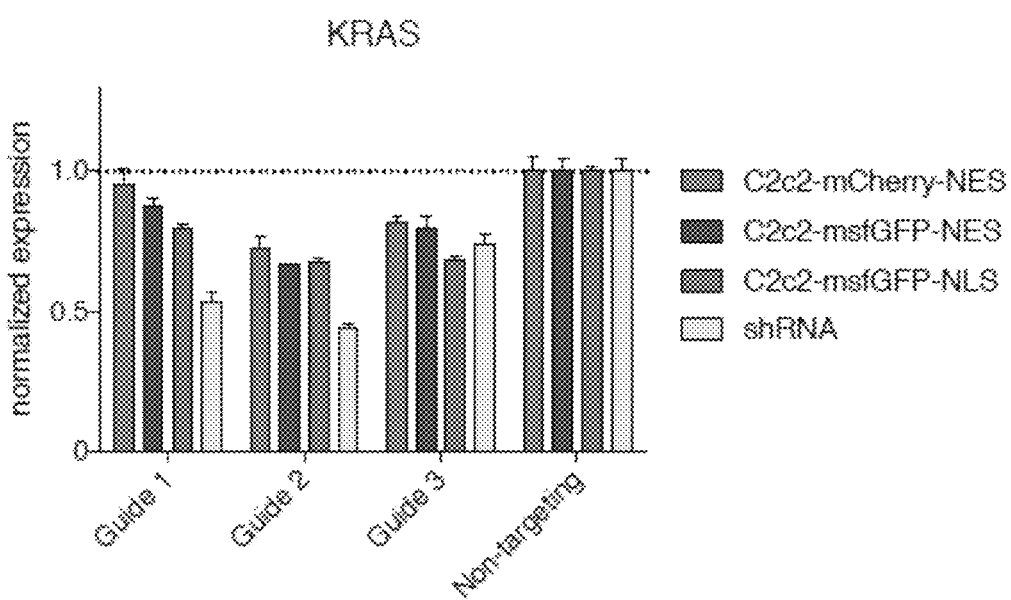
Figure 6E:
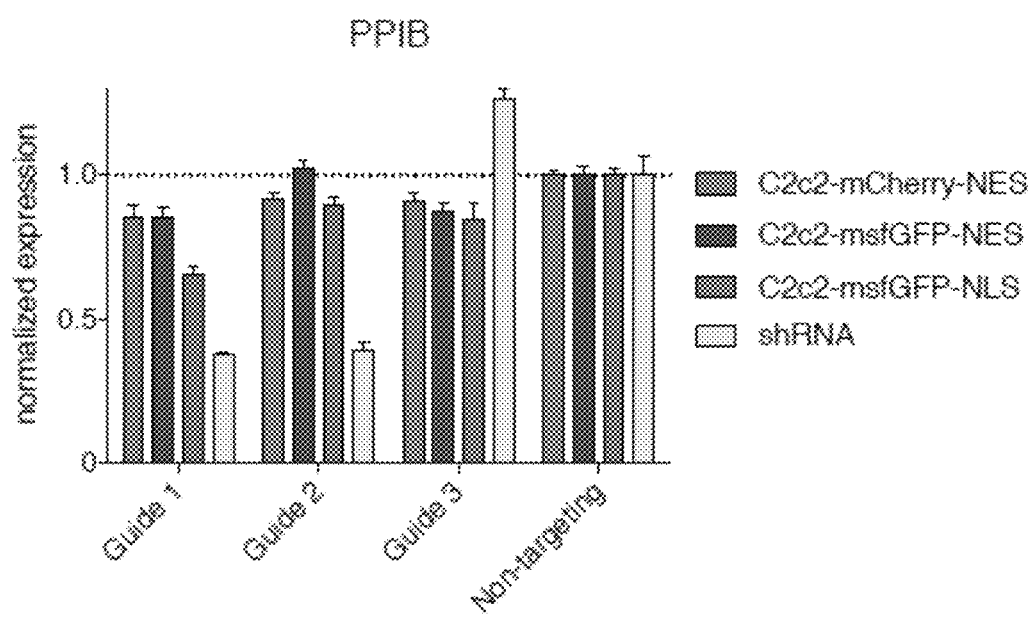

A targeting assay based on GFP expression was performed as indicated in FIG. 2C with different gRNAs directed against EGFP. C2c2 orthologues *Leptotrichia wadei* F0279 (Lw2) and *Listeria newyorkensis* FSL M6-0635 (LbFSL) were fused to an NLS or NES or alternatively were not fused to a localization signal. Normalized expression of GFP was determined and compared to non targeting (NT) gRNA. The results are shown in FIG. 5. Efficient knockdown was apparent. The spacer sequences used in the experiments as depicted in FIGS. 5A and 5B are as follows:
FIG. 5A

```
Guide 1
tgaacagctcctcgcccttgctcaccat  (SEQ ID
NO: 7)

Guide 2
tcagcttgccgtaggtggcatcgccctc  (SEQ ID
NO: 8)

Guide 3
gggtagcggctgaagcactgcacgccgt  (SEQ ID
NO: 9)

Guide 4
ggtcttgtagttgccgtcgtccttgaag  (SEQ ID
NO: 10)

Guide 5
tactccagcttgtgccccaggatgttgc  (SEQ ID
NO: 11)

Guide 6
cacgctgccgtcctcgatgttgtggcgg  (SEQ ID
NO: 12)

Guide 7
tctttgctcagggcggactgggtgctca  (SEQ ID
NO: 13)

Guide 8
gacttgtacagctcgtccatgccgagag  (SEQ ID
NO: 14)

Guide NT
tagattgctgttctaccaagtaatccat  (SEQ ID
NO: 4)
```

FIG. 5B

```
Guide 2
tcagcttgccgtaggtggcatcgccctc  (SEQ ID
NO: 8)

Guide 3
gggtagcggctgaagcactgcacgccgt  (SEQ ID
NO: 9)

Guide 4
ggtcttgtagttgccgtcgtccttgaag  (SEQ ID
NO: 10)

Guide 5
tactccagcttgtgccccaggatgttgc  (SEQ ID
NO: 11)

Guide 6
cacgctgccgtcctcgatgttgtggcgg  (SEQ ID
NO: 12)

Guide 7
tctttgctcagggcggactgggtgctca  (SEQ ID
NO: 13)

Guide 8
gacttgtacagctcgtccatgccgagag  (SEQ ID
NO: 14)

Guide NT
tagattgctgttctaccaagtaatccat  (SEQ ID
NO: 4)
```

A targeting assay was performed on different endogenous target genes in HEK293 cells with gRNAs directed against endogenous target genes. C2c2 *Leptotrichia wadei* F0279 (Lw2) was fused to an NES. Normalized protein expression of the respective target genes was determined (compared to non targeting (NT) gRNA). The results are shown in FIG. 7. Efficient knockdown was apparent. The spacer sequences used in the experiments as depicted in FIG. 7 are as follows:

FIG. 7

```
CTNNB1
ctgctgccacagaccgagaggcttaaaa    (SEQ ID
                                 NO: 15)

PPIB
tccttgattacacgatggaatttgctgt    (SEQ ID
                                 NO: 16)

mAPK14
tcaaggtggggtcacaggagaagccaaa    (SEQ ID
                                 NO: 17)

CXCR4
atgataatgcaatagcaggacaggatga    (SEQ ID
                                 NO: 18)

TINCR
gcgtgagccaccgcgcctggccggctgt    (SEQ ID
                                 NO: 19)

PCAT1
ccagctgcagatgctgcagtttttggcg    (SEQ ID
                                 NO: 20)

CAPN1
ctggaaatggaagatgccggcatagcca    (SEQ ID
                                 NO: 21)

LETMD1
gatgacacctcacacggaccaccectag    (SEQ ID
                                 NO: 22)

MAPK14
taatactgctccagatatgggtgggcca    (SEQ ID
                                 NO: 23)

RB1
catgaagaccgagttatagaatactata    (SEQ ID
                                 NO: 24)

TP53
ggtgaaatattctccatccagtggtttc    (SEQ ID
                                 NO: 25)

KRAS
aatttctcgaactaatgtatagaaggca    (SEQ ID
                                 NO: 26)
```

Example 4: Translation Upregulation with Catalytically Inactive of C2c2 Fused to a Translation Activator/Promoter in Eukaryotic Cells Catalytically inactive C2c2 orthologues *Leptotrichia wadei* F0279 (Lw) and *Listeria newyorkensis* FSL M6-0635 (LbFSL) were generated.

Lw C2c2 was fused to an NES or without localization signal and optionally EIF4E.

LbFSL was fused to an NLS and optionally EIF4E.

Gluc was targeted (cf. FIG. 2).

Relative protein expression was evaluated based on comparison between targeting with C2c2 with and without EIF4E.

The results are shown in FIG. 10.

Efficient translation upregulation was apparent. The spacer sequence used in the experiment as depicted in FIG. 10 is tagattgctgttctaccaagtaatccat, and target has a 3×binding sites for this spacer.

Example 5: Co-Localization of C2c2 and its Target Beta-Actin Upon Treatment with NaAsO$_2$ The localization of C2c2 targeting beta-actin under influence of sodium arsenite (NaAsO$_2$) was investigated. A fusion construct of *Leptotrichia wadei* C2c2 with mCherry and NES was made and cloned in a mammalian expression vector together with a guide targeting beta-actin or a non-targeting guide. Cellular localization of C2c2 was evaluated based on mCherry expression, stress granules were labeled with G3BP1-GFP. Lw C2c2 targeting beta actin was found to localize to stress granules upon treatment with NaAsO$_2$ (FIG. 11A). This localization was guide-dependent as only seen with beta-acting targeting and not with non-targeting guides (FIG. 11B, 11C).

Example 6: Alternative crRNA Promoters are Used to Boost Knockdown Activity

In order to further increase the interference effect, the crRNA was placed under the control of the U6 promoter.

With the aim to improve efficiency of interference by C2c2, expression of genes targeted using tRNA-crRNA and U6 driven crRNA and shRNA were compared. Reliable target gene knockdown was observed with comparable efficiency as shRNA (FIG. 12, FIG. 14). Further experiments were performed to determine effect of increasing crRNA transfection amount (FIG. 13), increasing protein transfection amount (FIG. 15) and effect of DR-spacer-DR-spacer constructs (FIG. 16). It was found that C2c2 outperformed optimized shRNA for corresponding targets on endogenous genes.

Example 7: Fusion Constructs with C2c2

As demonstrated in FIG. 18, dLw2C2c2-EIF4E fusion can upregulate translation of three genes; Protein levels as measured by band intensity on western blot.

Example 8: Target Induced Non-Specific rNase Activity

C2c2 target induced non-specific rNase activity is useful to detect RNA species in samples. In the presence of an RNA target of interest, guide-dependent C2c2 nuclease activity is accompanied by non-specific RNAse activity against collateral targets. For example, a reporter RNA comprising a fluorescent moiety and a fluorescence quencher is non-specifically cleaved by activated C2c2. An RNA substrate is tagged with a fluorescent reporter molecule (fluor) on one end and a quencher on the other. In the absence of C2c2 rNase activity, the physical proximity of the quencher dampens fluorescence from the fluor to low levels. When C2c2 target specific cleavage is activated, the RNA substrate is non-specifically cleaved and the fluor and quencher are spatially separated. This causes the fluor to emit a signal when excited by light of the appropriate wavelength. A schematic of such an assay is shown in FIG. 24A.

Example 9: Biochemical Characterization of Lw2C2c2 (LwaCas13a)

Methodology is essentially as described in Abudayyeh et al. (2016) "C2c2 is a single-component programmable RNA-guided RNA-targeting CRISPR effector"; Science 353 (6299), DOI: 10.1126/science.aaf5573; and is incorporated herein by reference.

Because of LwaCas13a's desirable cleavage activity in bacterial cells, Applicants explored further biochemical characterization to better understand its cleavage prior to testing in mammalian cells. In vitro cleavage reactions with both LshCas13a and LwaCas13a demonstrated programmable target cleavage with a guide encoding a 28 nt spacer and a requirement for $Mg^{2+}$ (FIG. 3I) as well as confirming the in vivo increase of efficiency of LwaCas13a over LshCas13a. Incubation of single stranded RNA target (ssRNA 1) with LwaCas13a and guide showed detectable cleavage within 2 minutes with nearly complete cleavage after 30 minutes of incubation, while LwaCas13a without guide had no observable cleavage (FIG. 37), and cleavage was dose-dependent with LwaC2c2-guide complex levels (FIG. 36). Given the appearance of stereotyped cleavage products, Applicants hypothesized that LwaCas13a cleavage patterns were target-dependent, similar to LshCas13a (Abudayyeh, O. O. et al. C2c2 is a single-component programmable RNA-guided RNA-targeting CRISPR effector. *Science* 353, aaf5573, doi:10.1126/science.aaf5573 (2016)). Incubation with multiple RNA targets with various in silico-predicted secondary structures (FIG. 42) revealed substantially different cleavage patterns (FIG. 42). To determine if LwaCas13a cleavage depended on base identity in exposed single stranded regions on the target, Applicants incubated LwaCas13a on a target (modified ssRNA target 4) with homopolymer substitutions in a loop (FIG. 43). Applicants found stronger cleavage for targets with C or U substitutions (FIG. 43), showing that LwaCas13a has more substrate flexibility than LshCas13a, which preferentially cleaves at U residues (Abudayyeh, O. O. et al. C2c2 is a single-component programmable RNA-guided RNA-targeting CRISPR effector. *Science* 353, aaf5573, doi:10.1126/science.aaf5573 (2016)). In addition to target RNAse activity, the Cas13 family has been reported to process its own corresponding pre-crRNA transcript from *L. wadei* (FIG. 43C) (East-Seletsky, A. et al. Two district rNase activities of CRISPR-C2c2 enable guide-RNA processing and RNA detection, *Nature* 538, 270-273 (2016)). Applicants also explored the guide constraints on LwaCas13a cleavage by truncating either the spacer or the direct repeat (DR) sequences. Applicants found that LwaCas13a retained in vitro cleavage activity with spacer lengths as short as 20 nt (FIG. 41), and could cleave with DR truncations as short as 27 nt (FIG. 40), although one DR length truncation (32 nt) seemed to eliminate activity, possibly due to secondary structure perturbation. Although guide lengths less than 20 nt no longer display catalytic activity, the LwaCas13-guide complex could still retain binding activity, allowing for orthogonal applications with a single catalytic enzyme (Dahlman, J. E. et al. Orthogonal gene knockout and activation with a catalytically active Cas9 nuclease. Nat Biotechnol 33, 1159-1161, doi:10.1038/nbt.3390 (2015)).

Figure 3J:
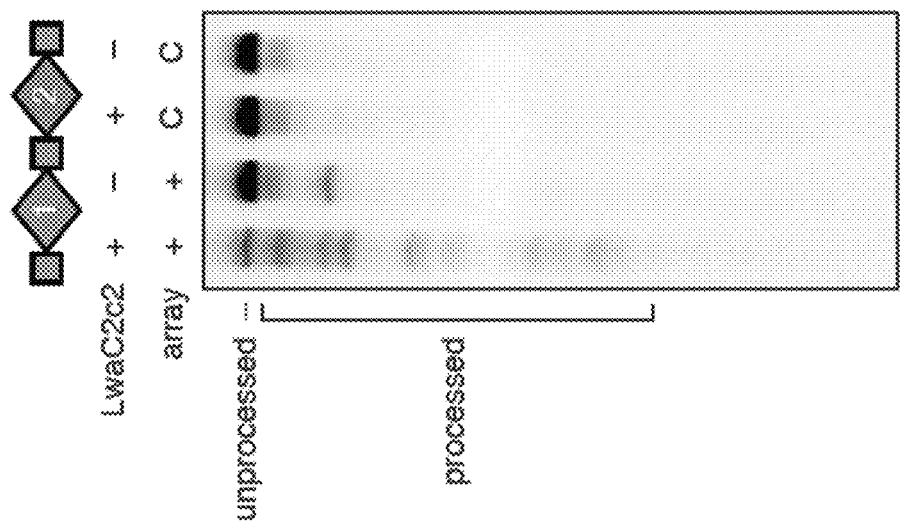
Figure 3K:
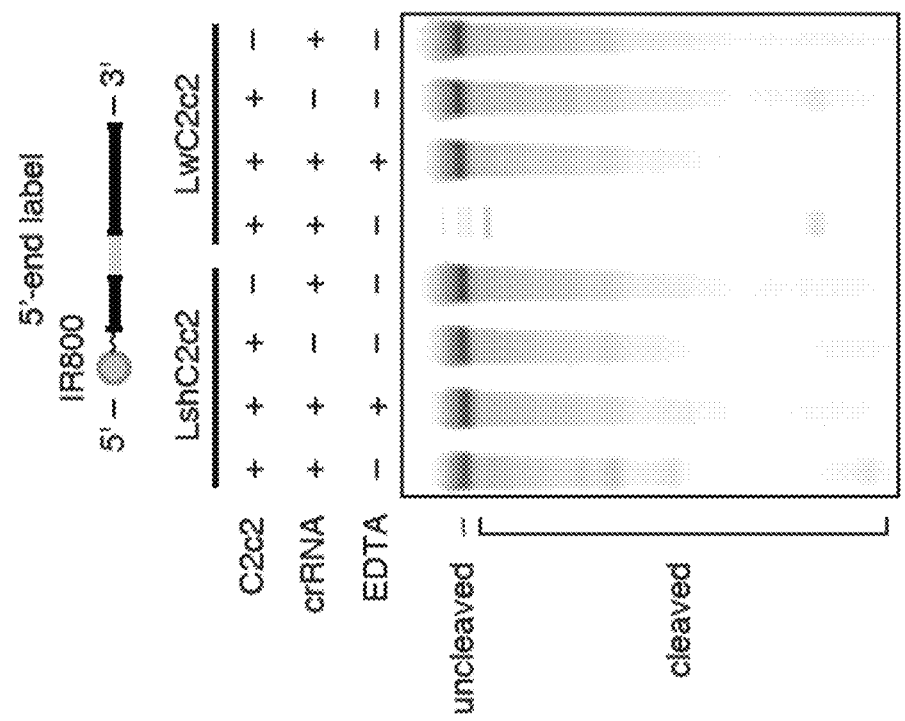
Figures 3L, 3M, 3N:
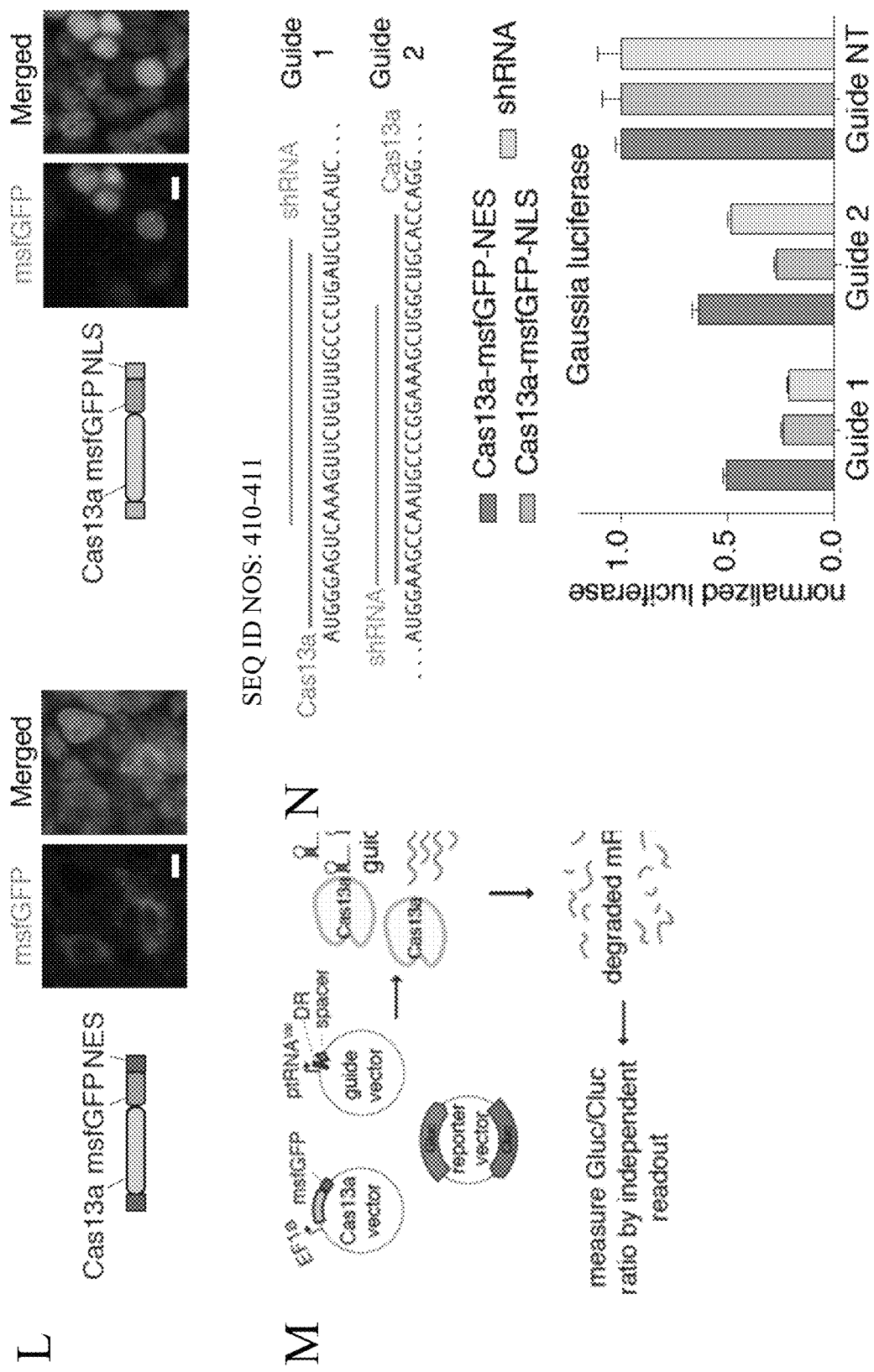

The Cas13 family has been found to have a dual RNAse activity for processing of full-length CRISPR transcripts (East-Seletsky, A. et al. Two distinct rNase activities of CRISPR-C2c2 enable guide processing and RNA detection. Nature 538, 270-273, doi:10.1038/nature19802 (2016)), in a manner similar to Cpf1 (Fonfara, I., Richter, H., Bratovic, M., Le Rhun, A. & Charpentier, E. The CRISPR-associated DNA-cleaving enzyme Cpf1 also processes precursor CRISPRRNA. *Nature* 532, 517-521, doi:10.1038/nature17945 (2016); Zetsche, B. et al. Multiplex gene editing by CRISPR-Cpf1 using a single guide array. *Nat Biotechnol* 35, 31-34, doi:10.1038/nbt.3737 (2017)). Applicants found that LwaCas13a could cleave the corresponding CRISPR spacer transcript from *L. wadei* (FIG. 3J) and this cleavage was concentration dependent (FIG. 15B). Furthermore, LwaCas13a showed collateral activity (FIG. 24B) on RNA products separated by gel electrophoresis (FIG. 24C), confirming previous characterization of collateral activity by cleavage of a quenched fluorophores (Gootenberg, J. S. et al. Nucleic acid detection with CRISPR-Cas13a/C2c2. *Science* In press (2017)).

*Leptotrichia wadei* F0279 (Lwa2) C2c2 was used in in vitro assays to evaluate cleavage kinetics (FIG. 36-37), dependence of cleavage activity on the presence of cations (FIG. 38), PFS preference (FIG. 39), effect of direct repeat length (FIG. 40), effect of spacer length (FIG. 41), effect of target RNA sequence and secondary structure (FIG. 42) and nucleotide cut preference (FIG. 43).

Example 10: LwaCas13a can be Reprogrammed to Knockdown Reporter mRNA

Figures 2A, 2B:
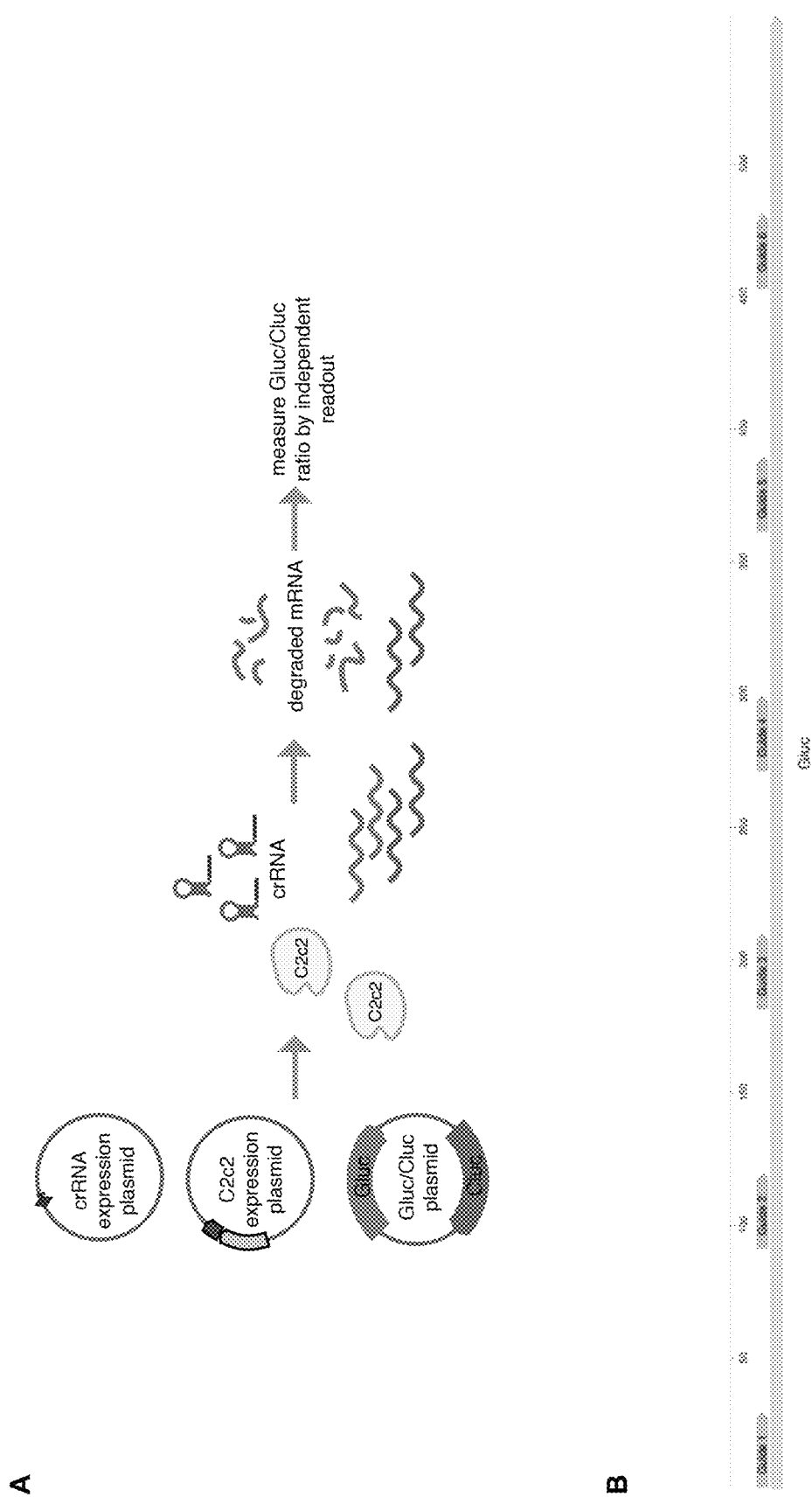

Given LwaCas13a's robust RNA cleavage activity and flexible sequence preference, Applicants decided to evaluate its ability to cleave transcripts in mammalian cells. Applicants first cloned mammalian codon-optimized LwaCas13a into mammalian expression vectors with msfGFP fusions on the C- or N-terminus and either a dual-flanking nuclear export signal (NES) or nuclear localization sequence (NLS) and evaluated expression and localization (FIG. 1D). Applicants found that msfGFP-fused LwaCas13a constructs expressed well and localized effectively to the cytoplasm or nucleus according to the localization sequence. To evaluate the in vivo cleavage activity of LwaCas13a Applicants developed a dual luciferase reporter system, which expresses both *Gaussia* luciferase (Gluc) and Cypridina luciferase (Cluc) under different promoters on the same vector, allowing one transcript to serve as the Cas13a target and the other to serve as a dosing control (FIG. 2A). Applicants then designed guides against Gluc and cloned them into a $tRNA^{Val}$-promoter-expressing guide vector. Applicants transfected the LwaCas13a expression vector, guide vector, and dual-luciferase construct into HEK293FTs and measured luciferase activity at 48 hours post transfection. Applicants found that nuclear-localized LwaCas13a-msfGFP resulted in the highest levels of knockdown (75.7% for guide 1, 72.9% for guide 2), comparable to position-matched shRNA controls (78.3% for guide 1, 51.1% for guide 2) (FIG. 6B), which control for accessibility and sequence in the target region. Because of the superior cleavage of the LwaCas13a-msfGFP-NLS construct, Applicants used this design for all further knockdown experiments. The nuclear localized LwaCas13a-msfGFP also fared better than mCherry-fused versions, likely due to the enhanced stability offered by the msfGFP. The ability to manipulate LwaCas13a activity by engineered fusions highlights the flexibility of the Cas13a tool. LwaCas13a is also capable of knockdown in the A375 melanoma cell line (FIG. 6A, FIG. 9), demonstrating the versatility of Cas13. Applicants also found thatLwaCas13a yields the best Gluc knockdown with a spacer length of 28 nt (73.8%) (FIG. 6C) and that knockdown is dose-responsive to both the protein and guide or crRNA transfected vector amounts (FIG. 56A, 56B). Guide expression is not sensitive to promoter choice, and guide or crRNAs expressed from the $tRNA^{Val}$ or U6 promoters result in similar levels of Gluc knockdown (66.3% for $tRNA^{Val}$, 74.5% for U6) (FIG. 56C).

Figures 56E, 56F:
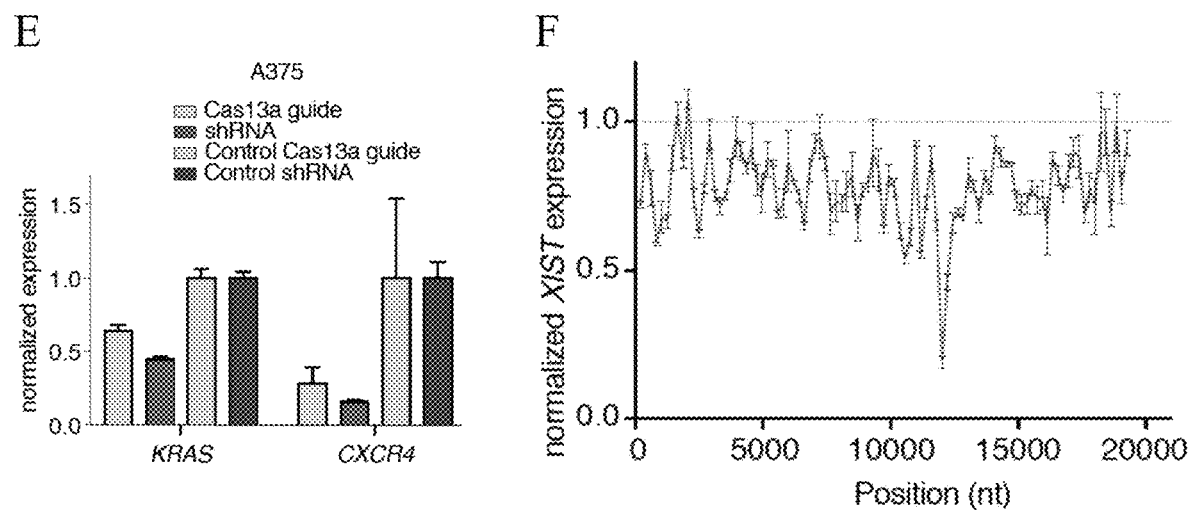
Figures 57A, 57B, 57C:
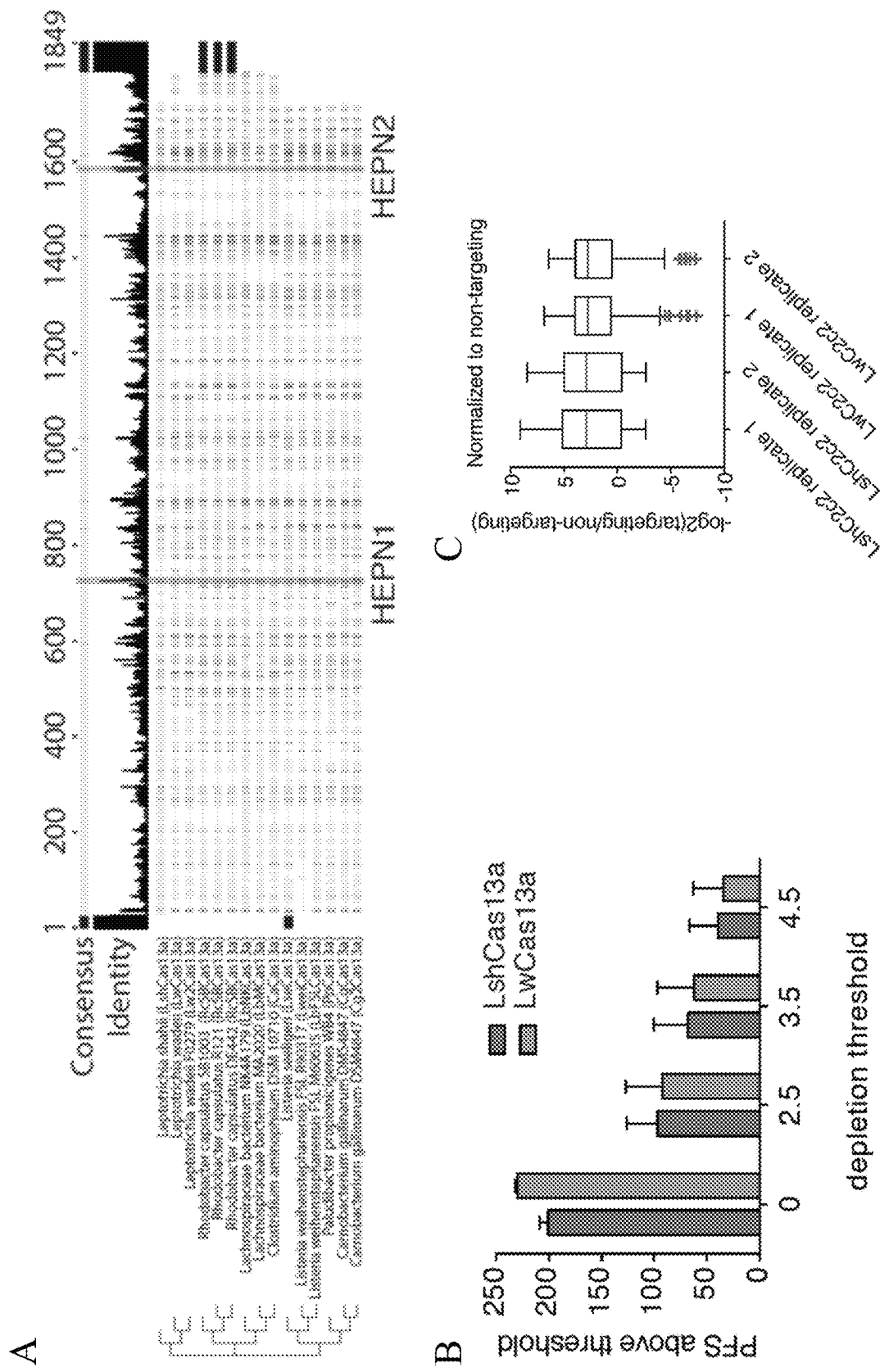
Figures 57D, 57E:
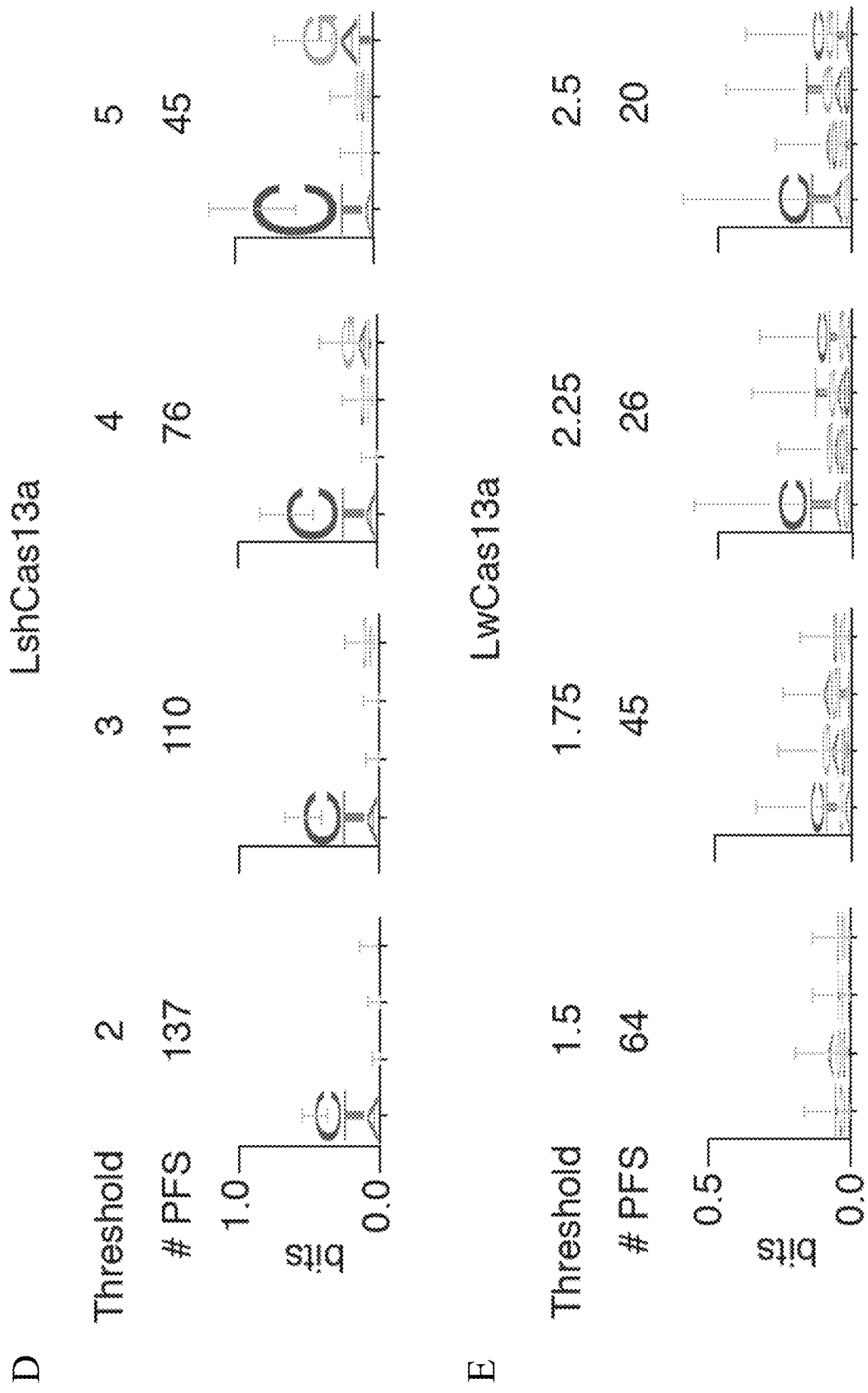

Applicants next tested knockdown on three endogenous genes: KRAS, CXCR4, and PPIB, and found that varying levels of knockdown, and for 2 of 3 genes, LwaCas13a knockdown (40.4% for PPIB, 83.9% for CXCR4, 57.5% for KRAS) was similar to RNAi with position-matched shR-NAs (63.0% for PPIB, 73.9% for CXCR4, 44.3% for KRAS) (FIG. 30). Applicants also found that endogenous gene knockdown was flexible to guide promoter choice, with similar levels of knockdown for guides expressed from the tRNA$^{Val}$ or U6 promoters (86.7% for tRNA$^{Val}$, 77.6% for U6) (FIG. 56D). Applicants also found that LwaCas13a is capable of knockdown in the A375 melanoma cell line (FIG. 56E). To expand the versatility of LwaCas13a knockdown, Applicants designed guides against transcripts for rice (*Oryza sativa*) genes EPSPS, HCT, and PDS and co-transfected the LwaCas13a and guide vectors into *O. sativa* protoplasts (FIG. 3P). After transfection, Applicants observed >50% knockdown of for all three genes and 7 out of 9 guides tested, with maximal knockdown of 78.0% (FIG. 3Q). Together, these results suggest that LwaCas13a is able to mediate similar levels of RNA knockdown as RNAi. Further exploration of additional members of the Cas13 family may reveal proteins able to achieve even more potent knockdown effect.

Figures 32A, 32B, 32C, 32D:
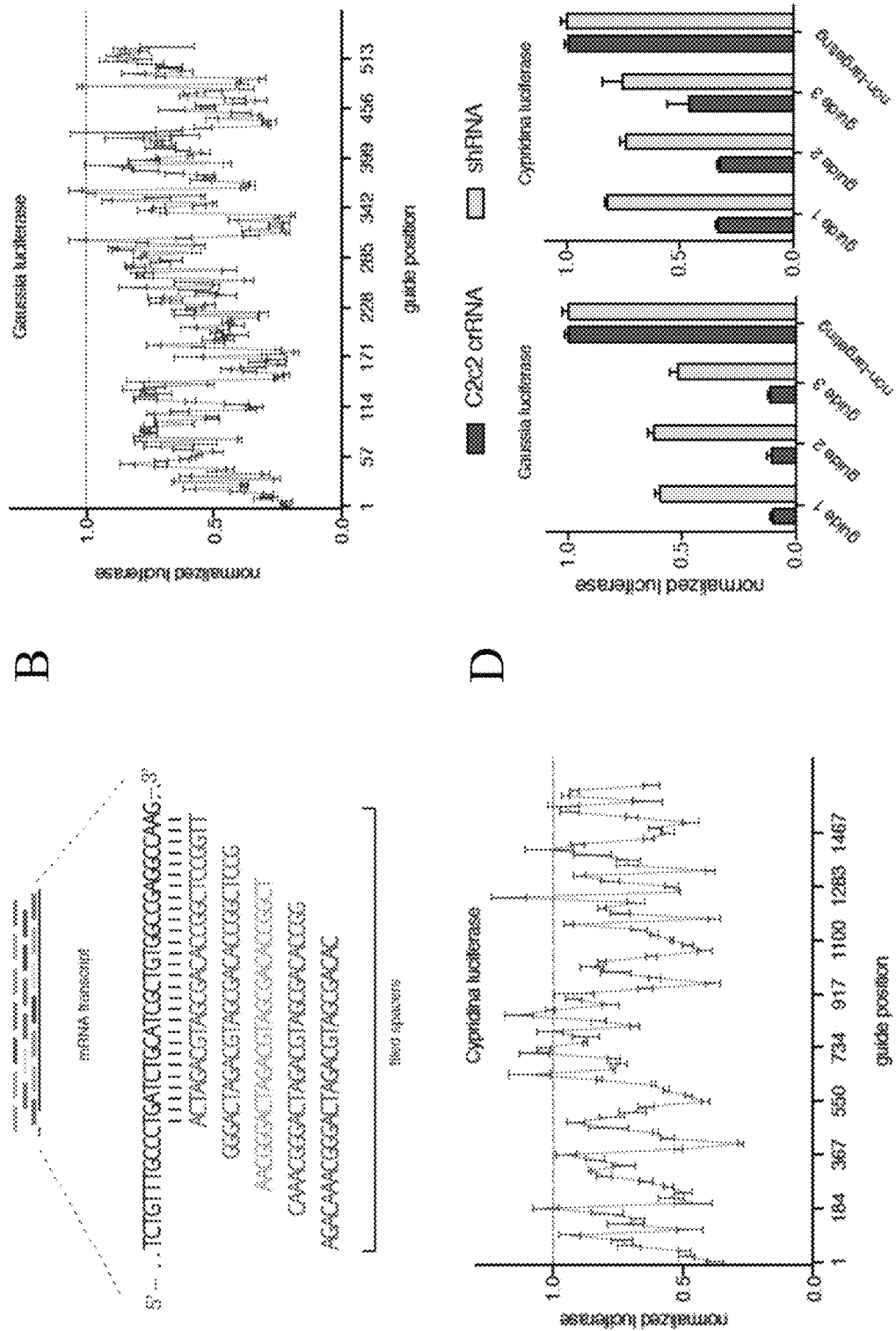

Example 11: LwaCas13a Knockdown Screening of Reporter and Endogenous Transcripts To comprehensively characterize the dependence of RNA context on the efficiency of LwaCas13a knockdown, Applicants harnessed the programmability of LwaCas13a to tile guides along the length of the Gluc, KRAS, PPIB or Cluc transcripts (FIG. 32A). The Gluc and Cluc screens revealed guides with greater than 60% knockdown (FIG. 32), and that a majority of Gluc targeting guides had more than 50% knockdown with up to 83% maximal knockdown. To compare LwaCas13a knockdown with RNAi, Applicants selected the top three performing guides against Gluc and Cluc and compared them to position-matched shRNAs. Applicants found that five out of six top performing guides achieved significantly higher levels of knockdown (p<0.05) than their matched shRNA (FIG. 32D).

Having demonstrated robust knockdown on reporter genes, Applicants next explored whether Cas13a could be engineered to target endogenous transcripts via tiling of two genes, KRAS and PPIB. Applicants found that, while knockdown efficiency was transcript dependent, Applicants could still find guides capable of achieving 50% knockdown on either target with maximal knockdown of 85% and 75% for KRAS and PPIB, respectively (FIG. 49A, 49B). Applicants also found that endogenous gene knockdown was flexible to guide expression design, with similar levels of knockdown for crRNAs expressed from the tRNA$^{Val}$ or U6 promoters (FIG. 56D).

To further understand the efficiency of LwaCas13 knockdown versus RNAi, Applicants compared a variety of guides to shRNA constructs that were position matched to the same target region. Applicants selected the top three guides from each of the endogenous tiling screens (KRAS and PPIB) and observed robust knockdown with Cas13a (53.7%-88.8%) equivalent to levels attained by shRNA knockdown (61.8%-95.2%), with shRNA better for 2 out of 6 guides (p<0.01) and Cas13a better for 2 out of 6 guides (p<0.01) (FIG. 49H).

Figure 58A:
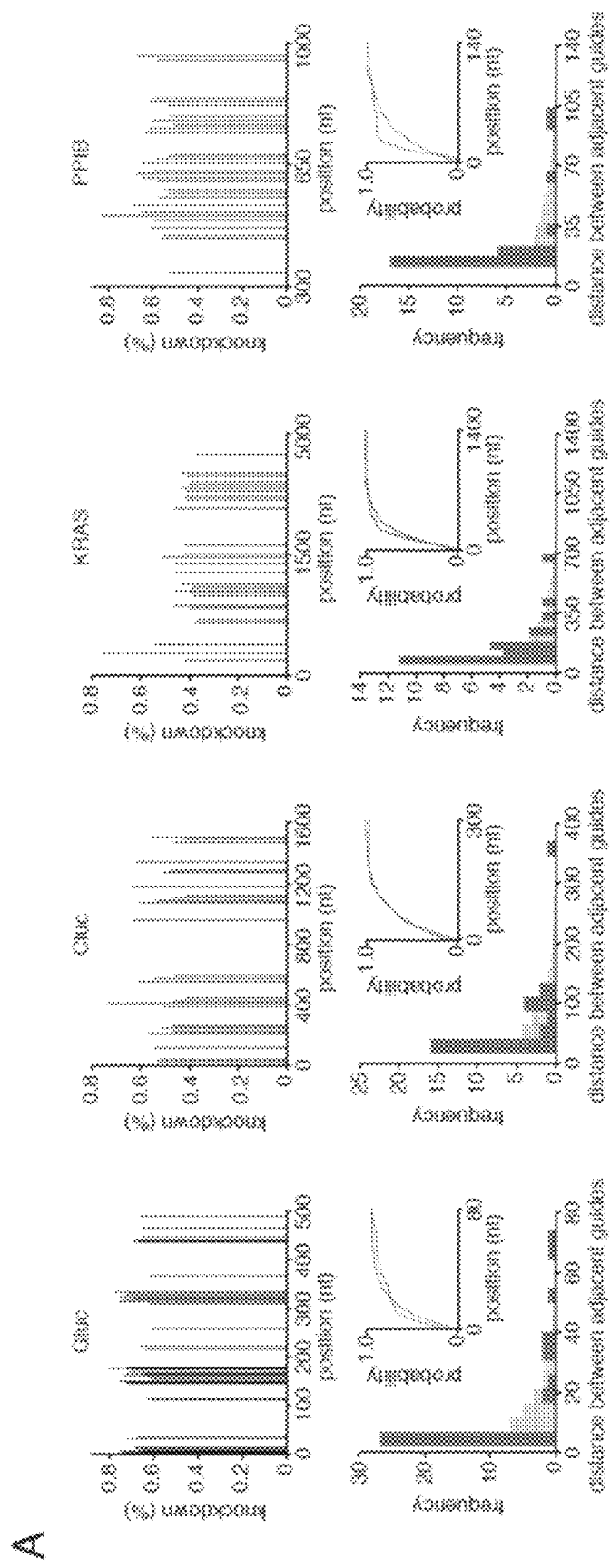

Example 12: LwaCas13a Knockdown is Optimal at Accessible Sites in the Target Transcript Since Applicants found that LshCas13a activity was governed by target accessibility in *E. coli* (Abudayyeh, O. O. et al. C2c2 is a single-component programmable RNA-guided RNA-targeting CRISPR effector. *Science* 353, aaf5573, doi: 10.1126/science.aaf5573 (2016)), Applicants decided to investigate whether LwaCas13a activity was increased for guides located in regions of accessibility along the four transcripts targeted in our guide tiling screens. Applicants first found that the most effective guides seemed to cluster into defined regions (FIG. 58A) and by comparing the pair-wise distances between effective guides to the null distribution, Applicants observed guides are significantly more closer together than would be expected by chance on all four transcripts (FIG. 58A). These initial clustering results suggest that regions of accessibility may be enriched for better LwaCas13a cleavage activity.

Figures 58B, 58C:
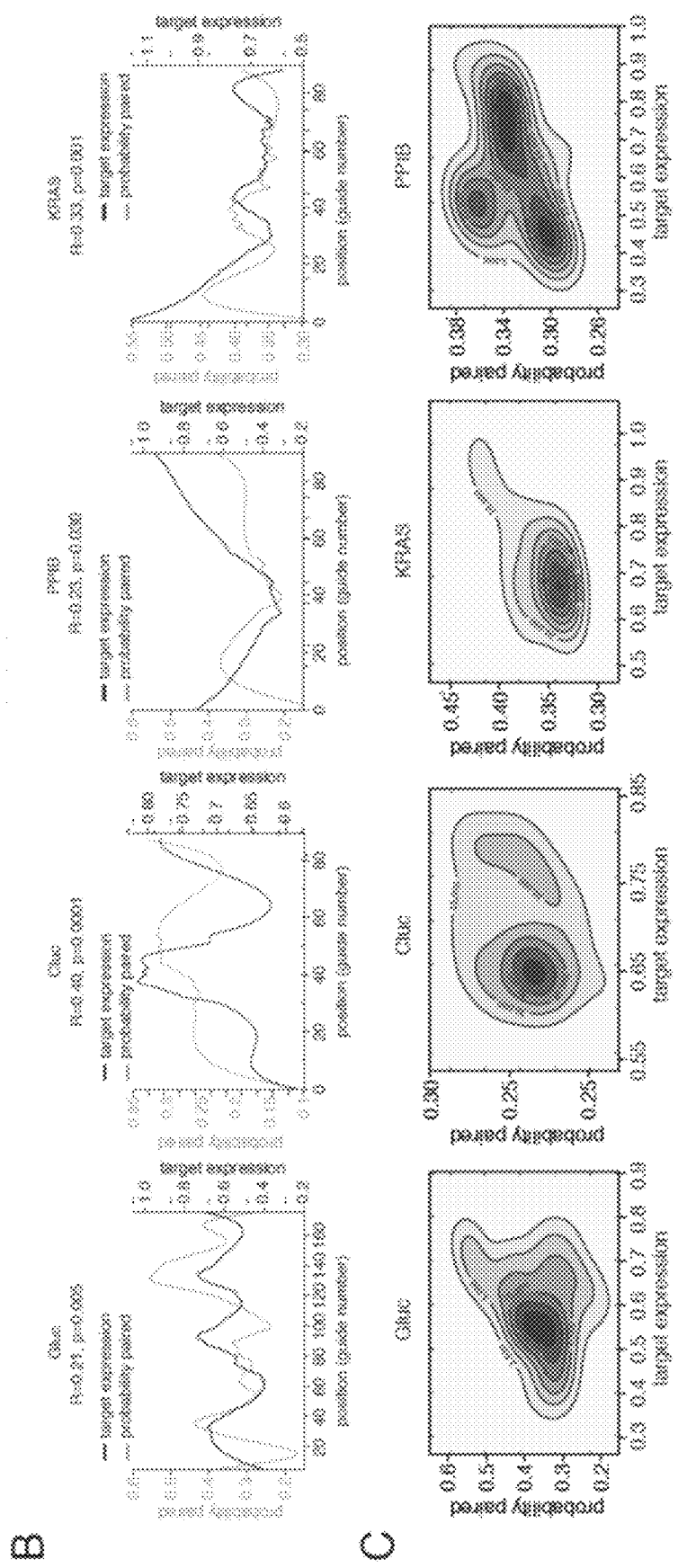
Figure 58D:
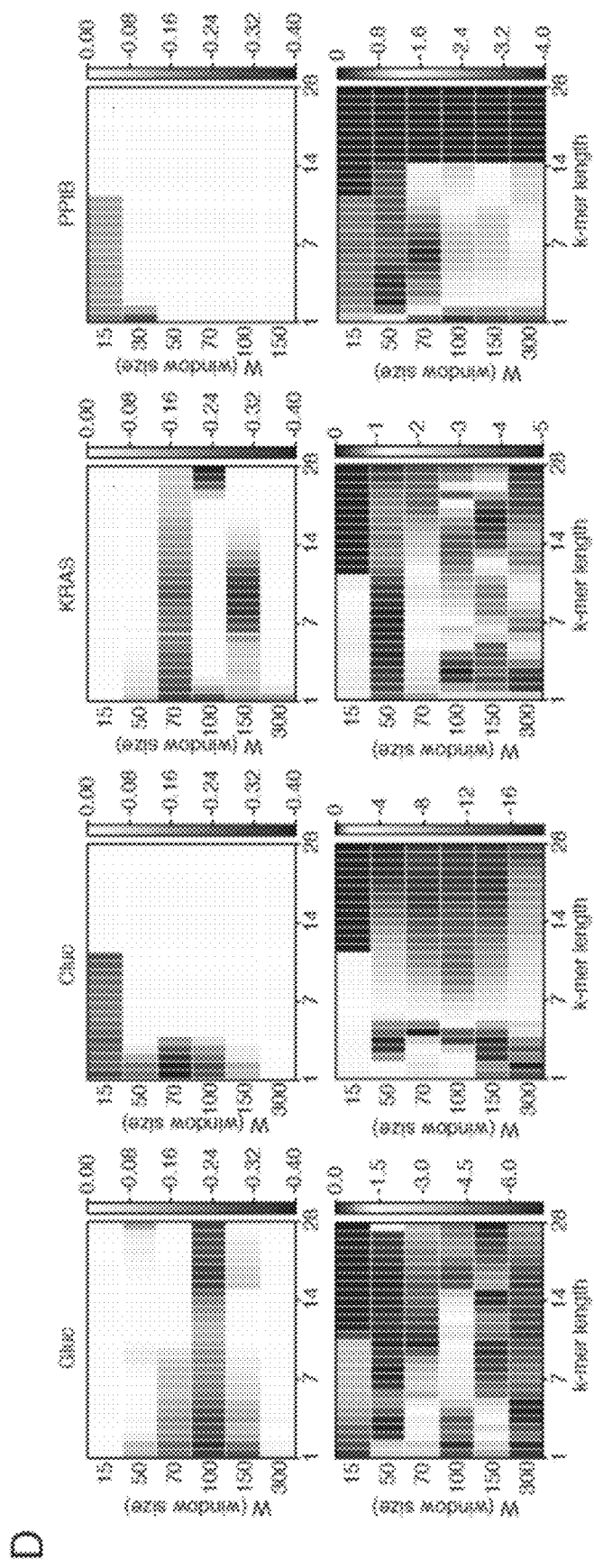

To confirm that transcript accessibility influenced LwaCas13a activity, Applicants computationally predicted accessibility of all target regions across each of the transcripts and found that these computational predictions were partially correlated to knockdown efficiency (FIG. 58B-D). Across the four targeted transcripts, predicted target accessibility could explain some of the variation in targeting efficacy (4.4%-16% of the variation in knockdown), indicating that while accessibility is a determinant of knockdown efficiency, other factors such as base-identity, sequence properties and protein binding to the RNA may also play important roles in targeting efficacy. More extensive screening in the future will likely be able to elucidate these mechanisms more clearly.

Figures 48A, 48B:
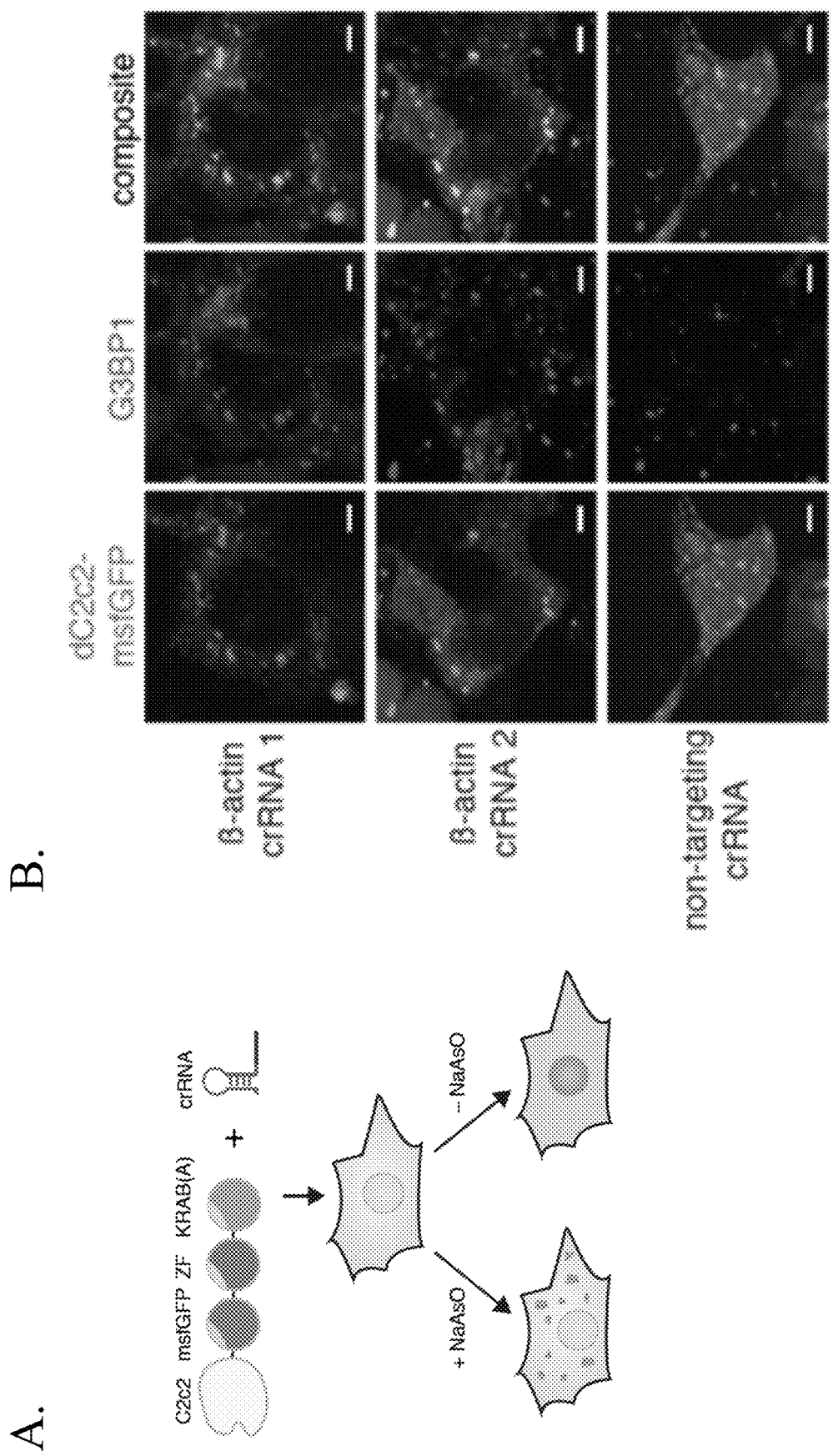
Figures 48C, 48D:
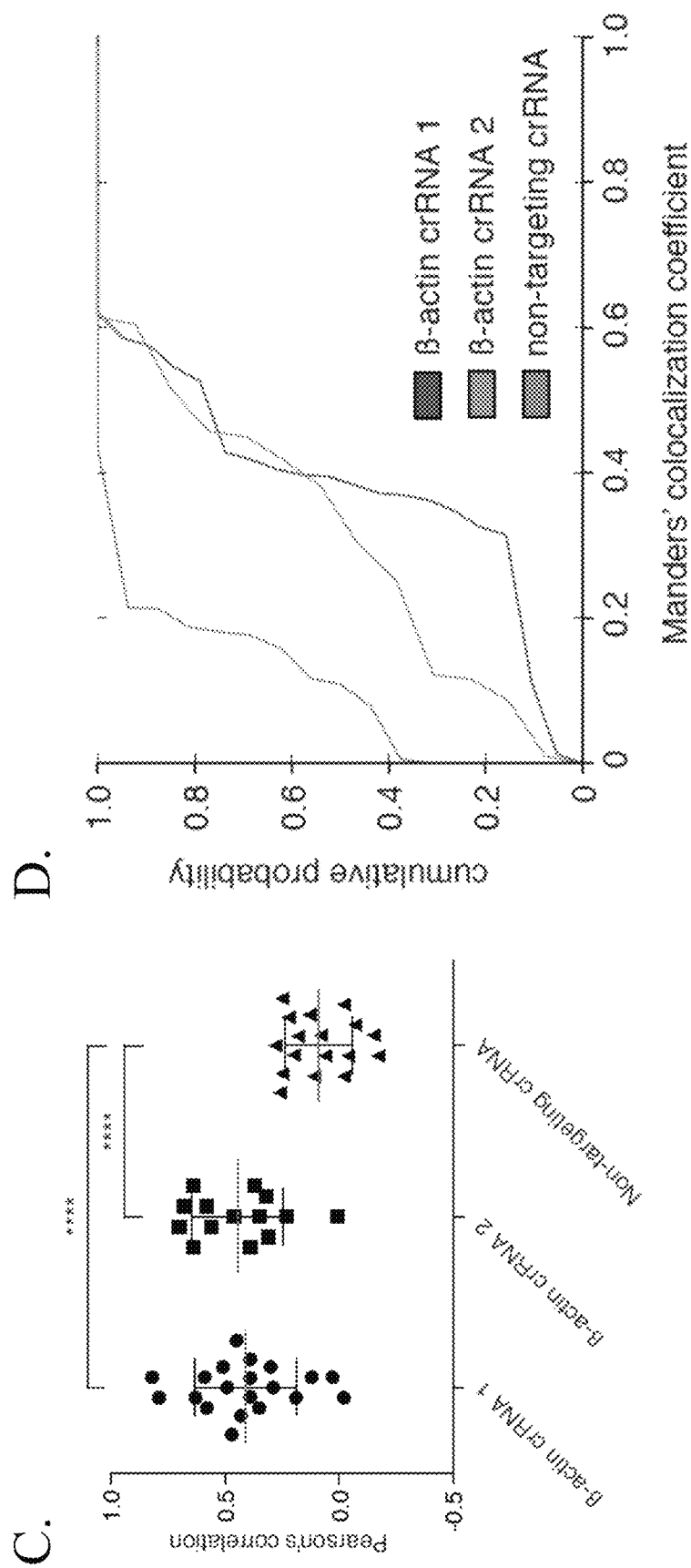

Example 13: Comparison of LwaCas13a Knockdown and RNAi on Endogenous Transcripts To further understand the efficiency of LwCas13 knockdown versus RNAi, Applicants compared a variety of guides to shRNA constructs that were matched to the same target region. Applicants first selected the top three guides from each of the endogenous tiling screens (KRAS and PPIB) and observed robust knockdown with Cas13a with knockdown equivalent to shRNA for almost every guide (FIG. 49C). To further compare to shRNA, Applicants also designed Cas13a crRNAs in regions of accessibility predicted by the RNAxs algorithm for KRAS, PPIB, and CXCR4 and found comparable levels of knockdown to shRNA (FIG. 48D).

Example 14: LwaCas13a Knockdown Screening of MALAT1 lncRNA

Because LwaCas13a can be engineered for cellular localization, it has versatility for which compartments of the cell can be targeted for RNA knockdown. Applicants designed 93 guides tiled evenly across the entire lncRNA MALAT1 transcript, which is nuclear localized, and transfected these guides with nuclear-localized LwaCas13a. Applicants found varying levels of knockdown, with up to as much as about 40% to 50% knockdown in one experiment (FIG. 49E). Compared against position-matched shRNA, which showed no detectable knockdown (p>0.05), Cas13a achieved significantly higher levels of knockdown (39.0-66.5%, p<0.05) (FIG. 49J). Applicants also tiled the lncRNA XTST transcript, and found an average of 22.0% and a maximum of 83.9% knockdown across all guides (FIG. 56F).

Example 15: Multiplexed Knockdown of Endogenous Transcripts

Other CRISPR effectors with CRISPR array processing activity, such as Cpf1, have been leveraged for multiplexed gene editing by expressing many guides under one promoter (Zetsche, B. et al. Multiplex gene editing by CRISPR-Cpf1 using a single guide array. *Nat Biotechnol* 35, 31-34, doi: 10.1038/nbt.3737 (2017)). Because LwaCas13a can process its own array, Applicants decided to test multiplexed delivery of LwaCas13a guides as a CRISPR array expressed under a single promoter. Applicants designed five different guides against the endogenous PPIB, CXCR4, KRAS, TINCR, and PCAT transcripts, and delivered the targeting system as a CRISPR array with 28 nt guides flanked by 36 nt direct repeats (DR), representing an unprocessed DR and a truncated spacer, under expression of the U6 promoter. With this approach, Applicants found levels of knockdown for each gene that were comparable to single or pooled guide controls (FIG. 49F).

Because of concerns that off-target LwaCas13a activity might be causing non-specific knockdown of the five transcripts targeted by the CRISPR array, Applicants designed an experiment with multiplexed delivery of three guides against PPIB, CXCR4, and KRAS and three variants where each one of the three guides was replaced with a non-targeting guide. Applicants found that in each case where a guide was absent from the array, there was no significant knockdown of the transcript targeted by the missing guide and only the targeted transcripts were knocked down by LwaCas13a, demonstrating that knockdown is not due to nonspecific degradation of the transcripts, but is in fact due to specific, multiplexed knockdown by LwaCas13a (FIG. 49G).

Example 16: LwaCas13a Knockdown is Sensitive to Mismatches

Figures 59A, 59B:
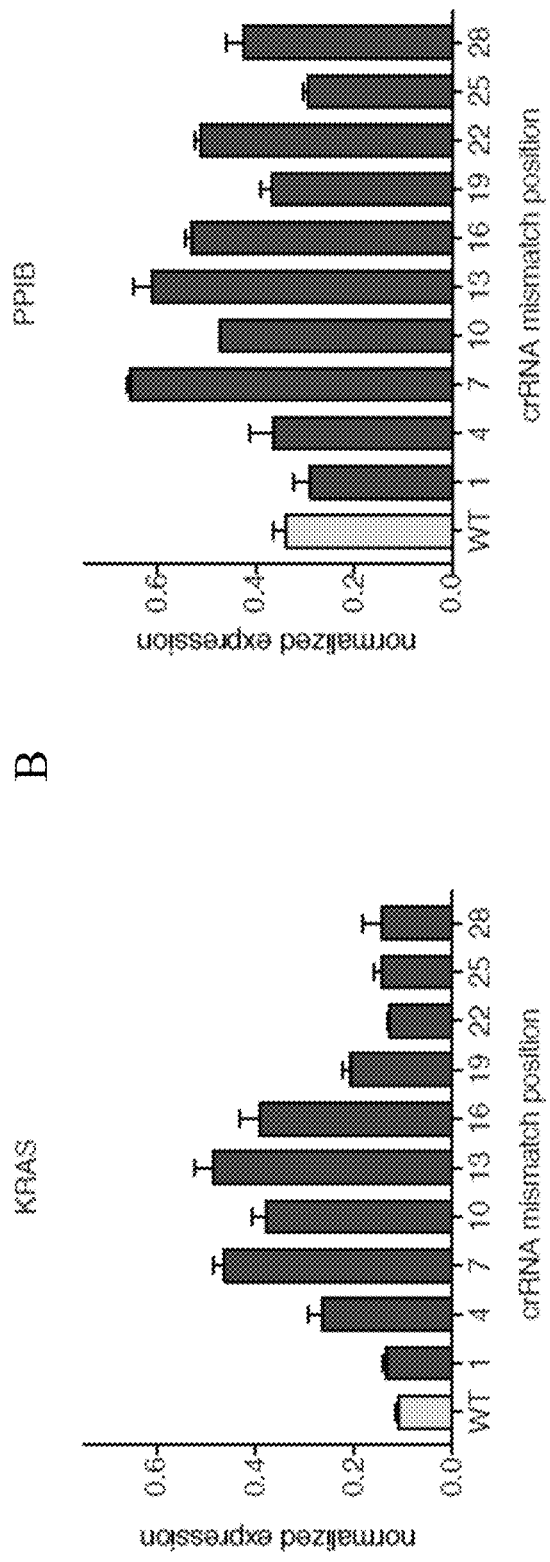
Figure 59C:
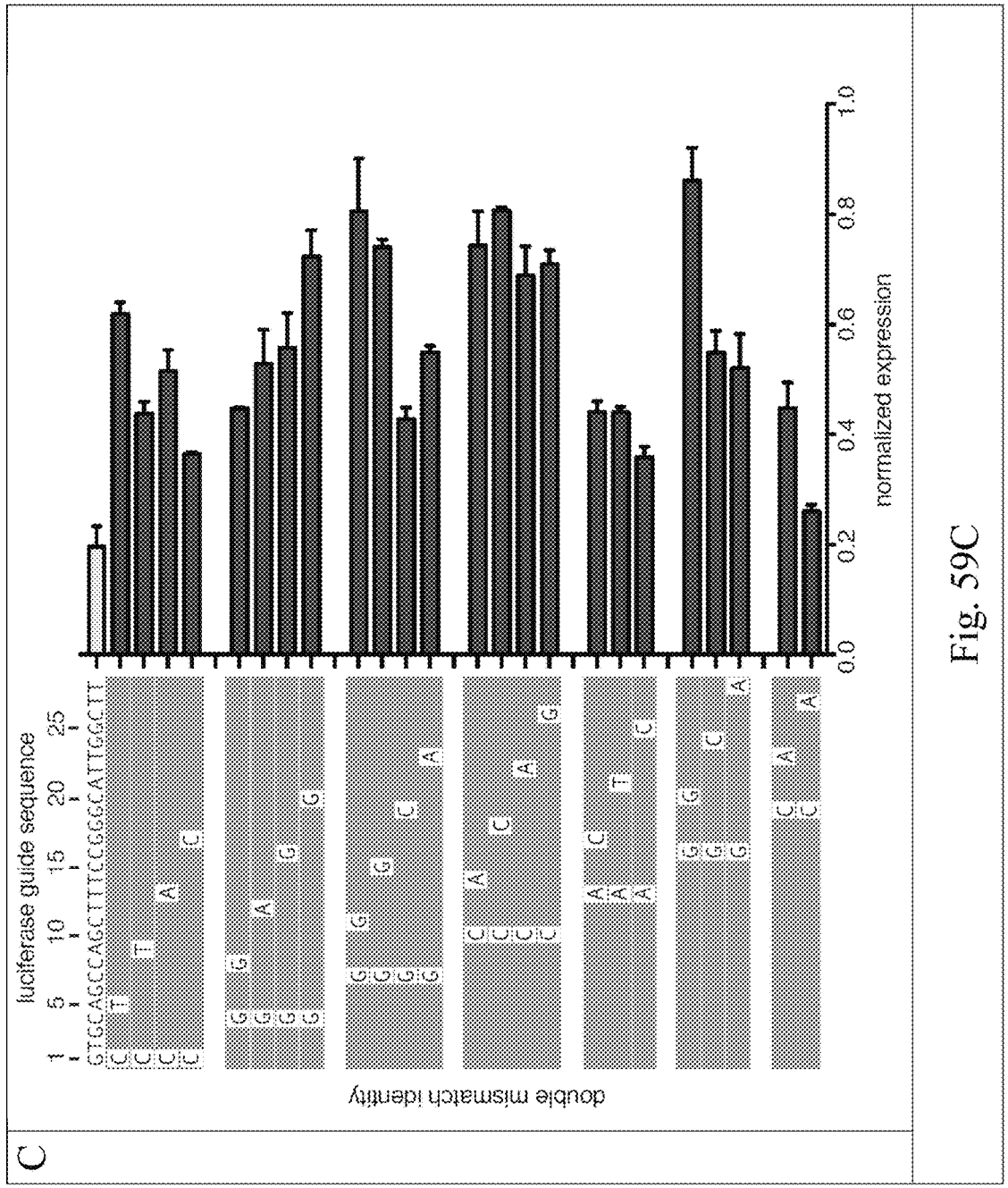

Specificity is a central concern for nucleic acid targeting tools, and the specificity of both RNAi and Cas9 DNA-targeting systems (Mali, P. et al. CAS9 transcriptional activators for target specificity screening and paired nickases for cooperative genome engineering. *Nat Biotechnol* 31, 833-838, doi:10.1038/nbt.2675 (2013); Fu, Y. et al. High-frequency off-target mutagenesis induced by CRISPR-Cas nucleases in human cells. *Nat Biotechnol* 31, 822-826, doi:10.1038/nbt.2623 (2013); Pattanayak, V. et al. High-throughput profiling of off-target DNA cleavage reveals RNA-programmed Cas9 nuclease specificity. *Nat Biotechnol* 31, 839-843, doi:10.1038/nbt.2673 (2013); Hsu, P. D. et al. DNA targeting specificity of RNA-guided Cas9 nucleases. *Nat Biotechnol* 31, 827-832, doi:10.1038/nbt.2647 (2013); Doench, J. G. et al. Optimized sgRNA design to maximize activity and minimize off-target effects of CRISPR-Cas9. *Nat Biotechnol* 34, 184-191, doi:10.1038/nbt.3437 (2016)) has been extensively characterized. The initial characterization of LshCas13a showed that it could be sensitive to as few as two mismatches in vitro (Abudayyeh, O. O. et al. C2c2 is a single-component programmable RNA-guided RNA-targeting CRISPR effector. *Science* 353, aaf5573, doi:10.1126/science.aaf5573 (2016)), and specificity profiling of LwaCas13a via the collateral effect (Gootenberg, J. S. et al. Nucleic acid detection with CRISPR-Cas13a/C2c2. *Science* In press (2017)) revealed that discrimination could be achieved at double-nucleotide resolution, with single-nucleotide resolution in the seed region of the guide:target duplex. To investigate the specificity of Cas13a in vivo, Applicants introduced mismatches into guides targeting either Gluc (FIG. 29A) or the endogenous genes CXCR4, KRAS, and PPIB (FIG. 29B, FIG. 59A-59B). Applicants found that for all transcripts, the central region of the guide:target duplex was most sensitive to single mismatches, in agreement with the previous in vitro characterizations of Cas13a specificity (Abudayyeh, O. O. et al. C2c2 is a single-component programmable RNA-guided RNA-targeting CRISPR effector. *Science* 353, aaf5573, doi: 10.1126/science.aaf5573 (2016)). While knockdown was reduced in the seed region, Applicants found that single mismatches were not sufficient for substantial levels of specificity on some targets, such as Gluc. Tiling of consecutive double mismatches for spacers against Gluc (FIG. 29A) revealed that double mismatches resulted in up to 8-fold reduction of activity, showing the promise of Cas13a as a specific in vivo targeting tool. Applicants also investigated the effect of non-consecutive double mismatches and found that most double mismatches reduced the knockdown from 80.4% to less than 60%, except for double mismatches located in either the 5' or 3' distal ends of the guide sequence (FIG. 59C).

Figures 59D, 59E, 59F, 59G:
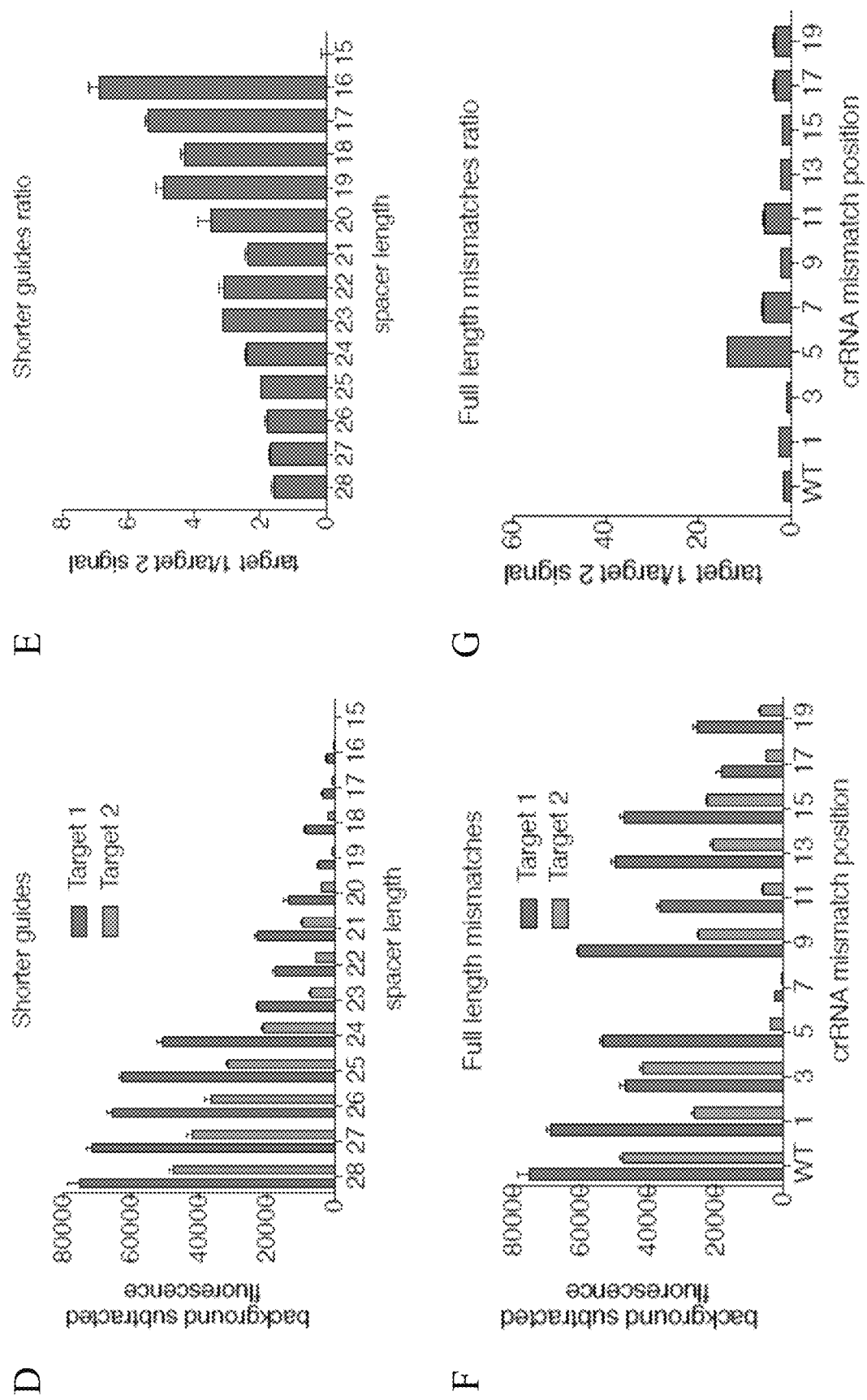
Figures 59H, 59I, 59J, 59K:
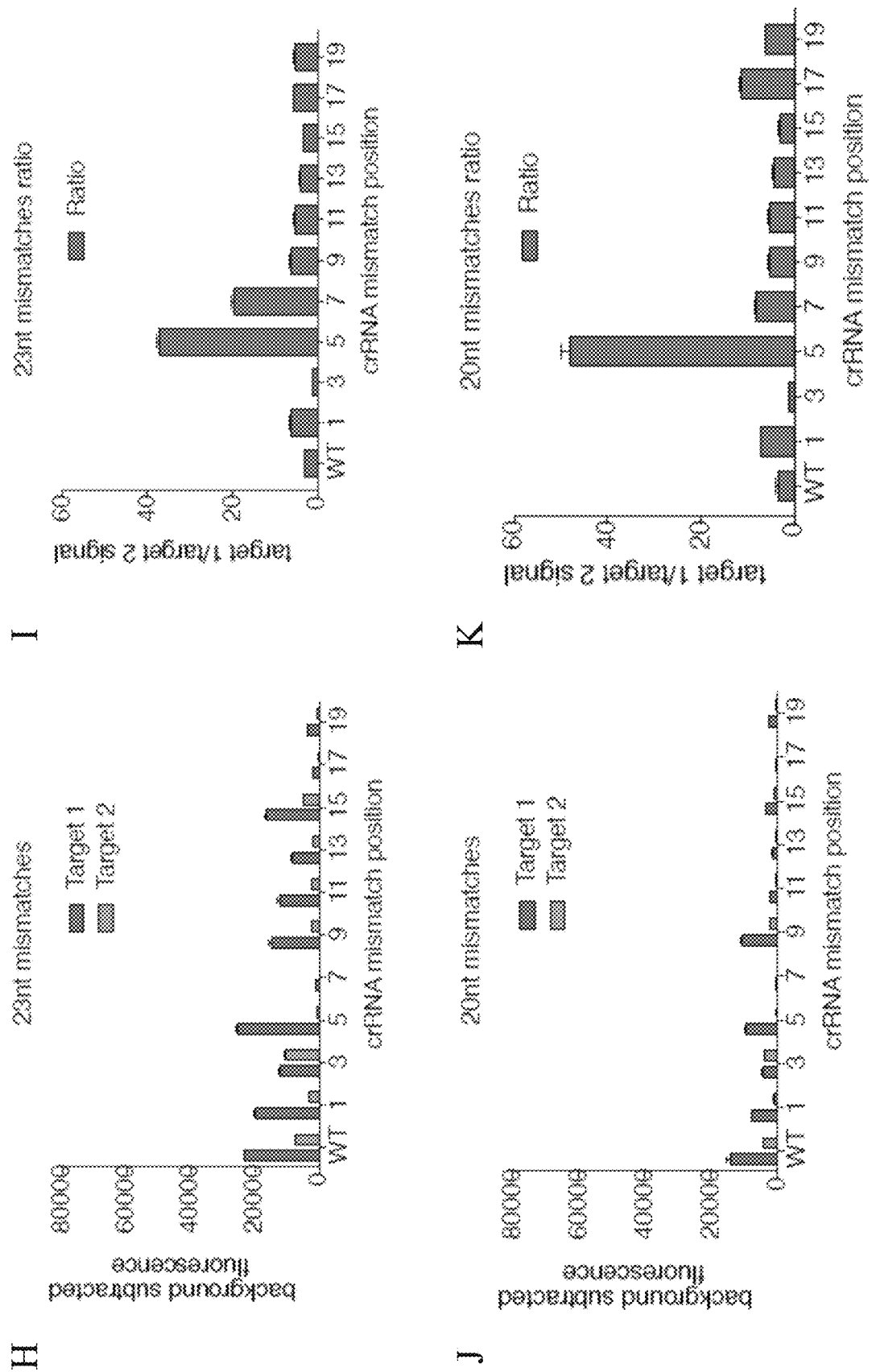

For further characterization of Cas13a across multiple specificity parameters in vitro, Applicants used detection of collateral activity (Gootenberg, J. S. et al. Nucleic acid detection with CRISPR-Cas13a/C2c2. *Science* In press (2017)) as a proxy for direct Cas13a activity. Given results from Cas9 experiments showing that specificity could be increased by shorter spacer lengths (Fu, Y., Sander, J. D., Reyon, D., Cascio, V. M. & Joung, J. K. Improving CRISPR-Cas nuclease specificity using truncated guide RNAs. *Nat Biotechnol* 32, 279-284, doi:10.1038/nbt.2808 (2014)), Applicants wondered whether spacer length had an effect on Cas13a specificity against two targets that differ by a single mismatch. Applicants found that while shorter spacers have reduced activity (FIG. 59D), as expected from our in vivo LwaCas13a results, shorter spacers also had improved single base-mismatch distinction (FIG. 59D,E). Applicants next explored if specificity could be improved by designing an additional synthetic mismatch in the spacer sequence, as this approach has successfully been used for single-mismatch distinction in vitro with LwaCas13a (Gootenberg, J. S. et al. Nucleic acid detection with CRISPR-Cas13a/C2c2. *Science* In press (2017)). Applicants found that, compared to full-length spacers (FIG. 59F, 59G), spacers truncated to either 23 nt (59H, 59I) or 20 nt (FIG. 59J, 59K) had less overall activity but substantially increased specificity. Taken together, the in vitro and in vivo engineering of LwaCas13a show promise for its use as a specific knockdown tool. The ability to engineer guides to confer single-base specificity should facilitate allele-specific transcript knockdown by LwaCas13a.

Example 17: Transcript Knockdown with LwaCas13a is Highly Specific

Figure 30A:
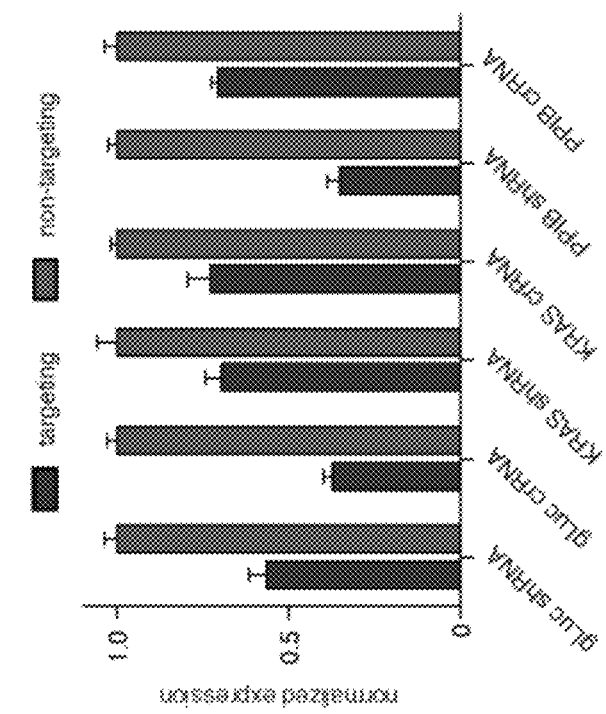
Figure 30B:
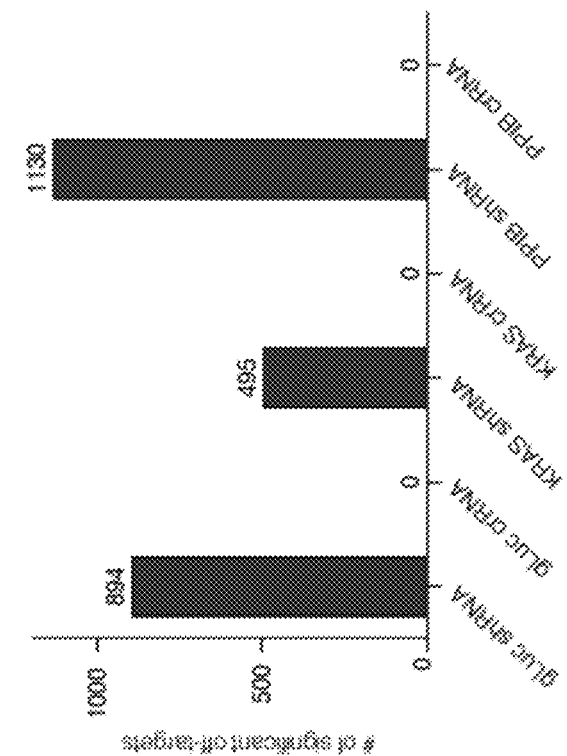
Figures 60A, 60B:
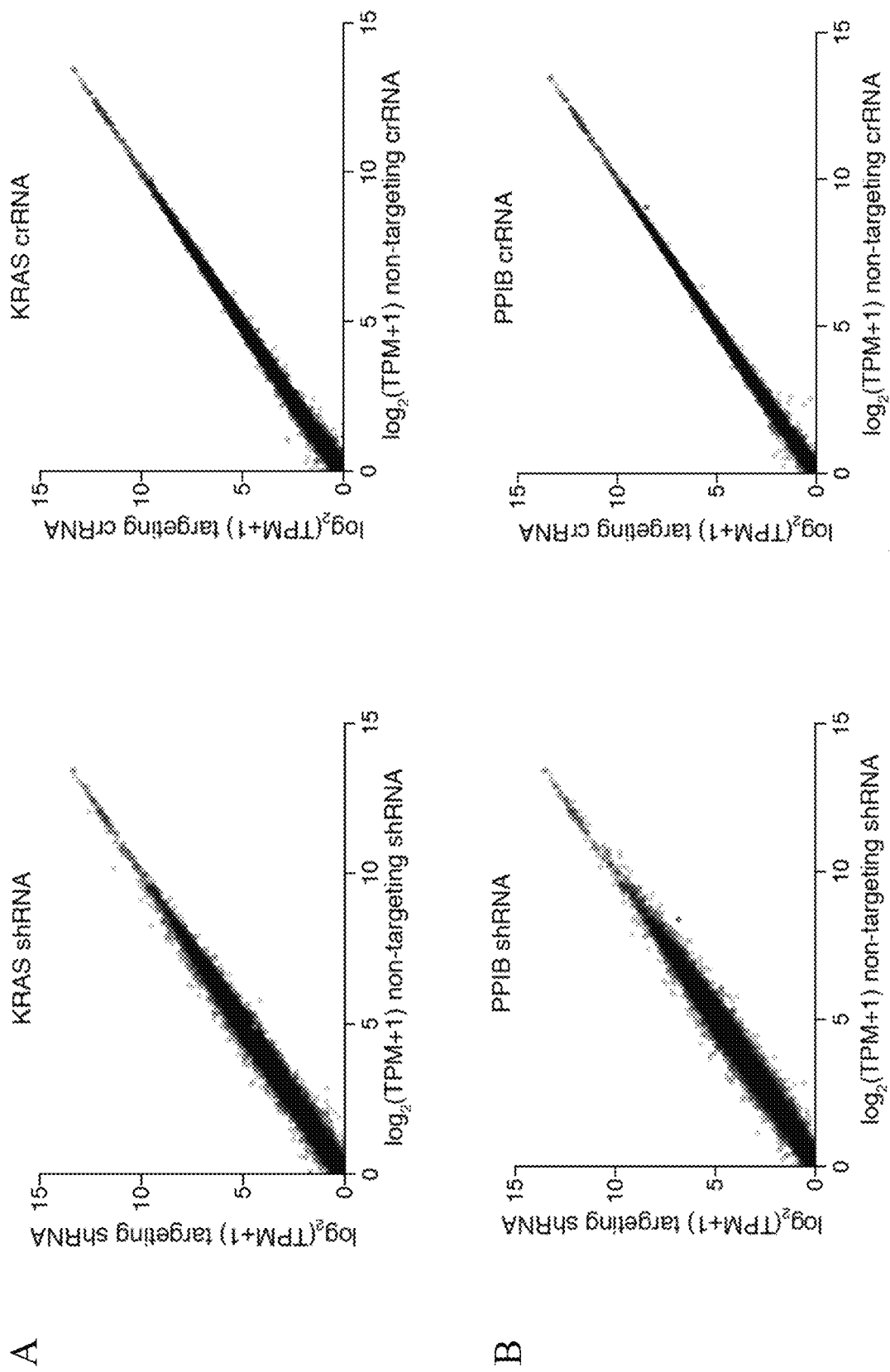
Figure 60C:
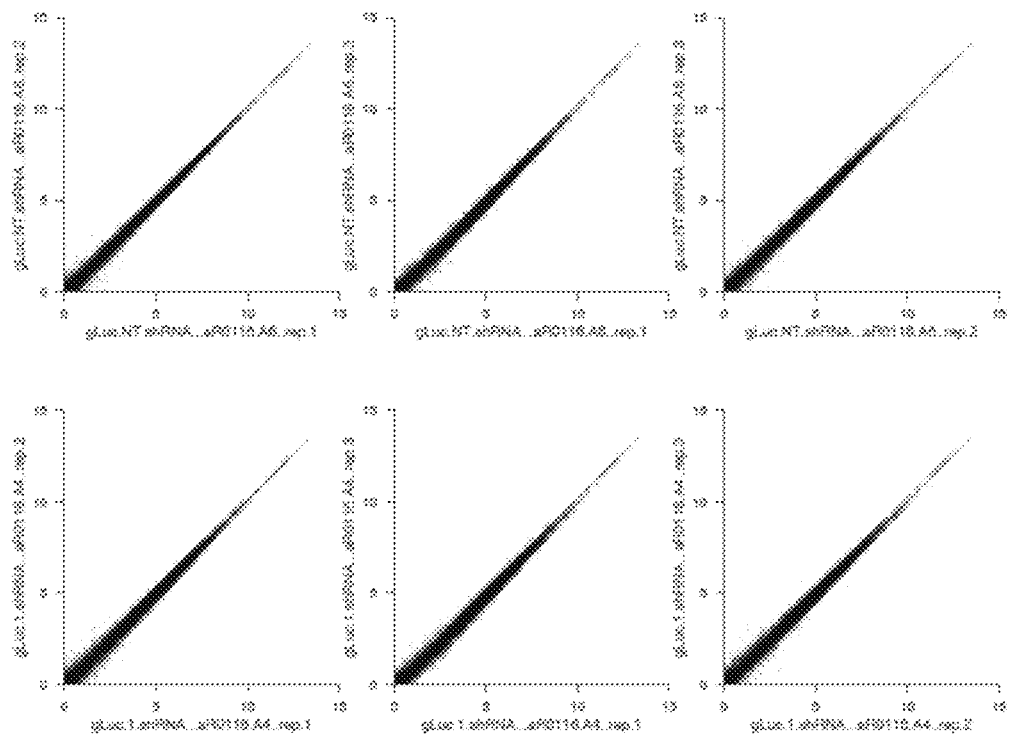
Figure 60D:
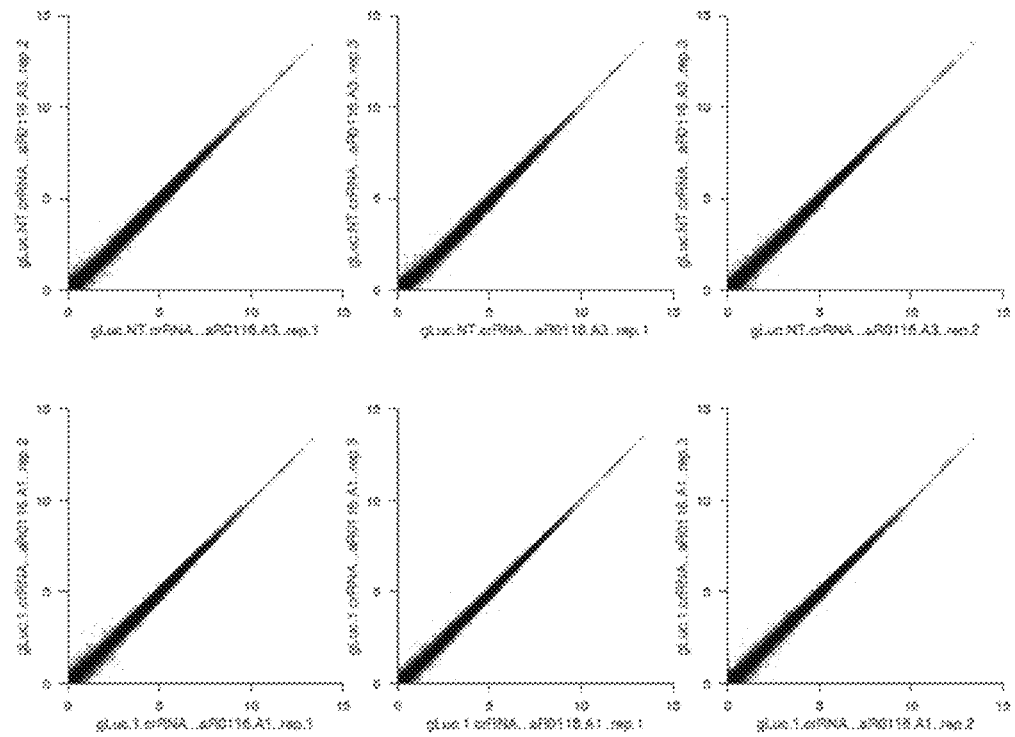
Figure 60E:
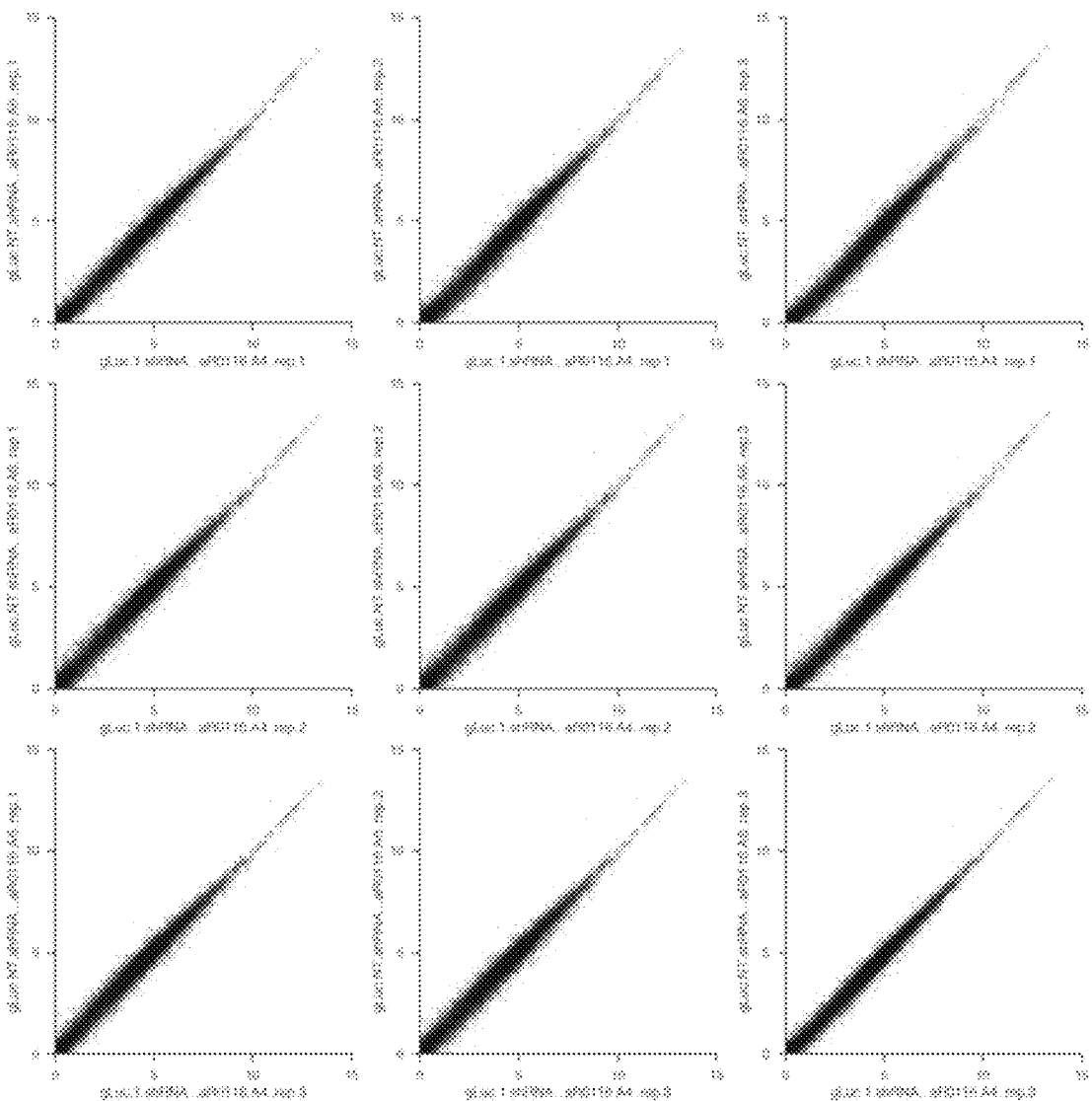
Figure 60F:
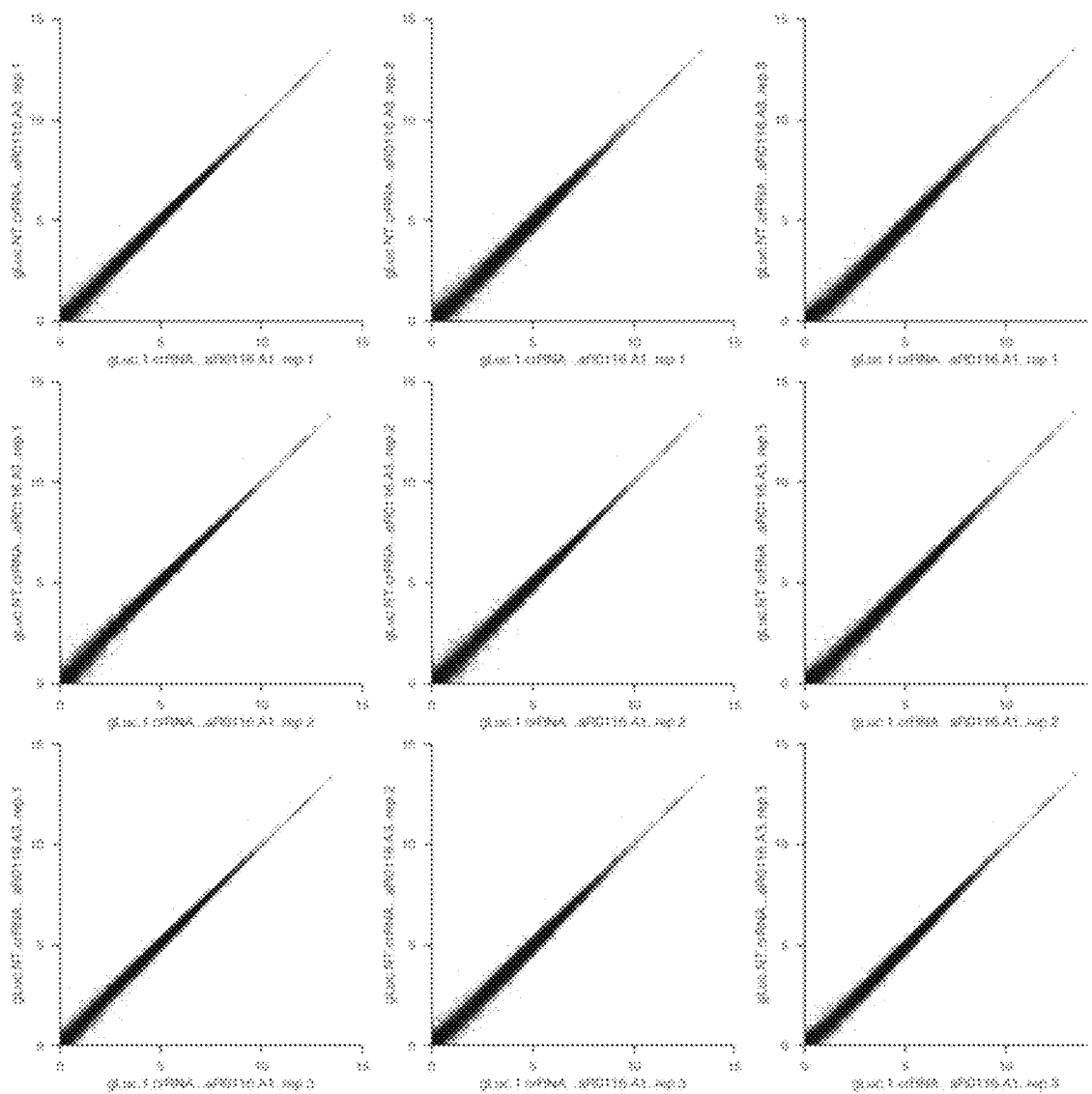

To comprehensively understand if there are any off-target effects of LwaCas13a knockdown, Applicants performed transcriptome-wide mRNA sequencing. Applicants targeted the Gluc transcript with LwaCas13a or a position matched-shRNA construct, and found significant knockdown of the target transcript (FIG. 29D-I). Similar results were found for the same comparison on two endogenous genes KRAS and PPIB (FIG. 29D-II, 29D-III). shRNA conditions had more transcriptome-wide variation and weaker correlation between targeting and non-targeting controls than LwaCas13a conditions, suggesting more off-targets in the shRNA targeting experiment. Applicants further characterized the number of significant off-targets by differential expression analysis and found hundreds of off-targets in each of the shRNA conditions but zero-off targets in LwaCas13a conditions (FIG. 30A), despite comparable levels of knockdown of the target transcripts (30.5%, 43.5%, and 64.7% for shRNA, 62.6%, 27.1%, and 29.2% for Cas13a, for Gluc, KRAS, and PPIB, respectively) (FIG. 30B). Applicants performed additional analysis of the Gluc targeting RNA-seq comparisons, and found that the dominant source of variability in shRNA conditions was due to differences between targeting and non-targeting conditions in individual replicates (average Kendall's tau=0.917) (FIG. 60C-60E). When individual replicates of the same condition were compared, there were much higher correlations and less variability (average Kendall's tau=0.941), indicating that the variation observed is from consistent off-target effects of a given shRNA construct. When this analysis is applied across all RNA-seq libraries analyzed for the three genes, all LwaCas13a conditions have high correlations with each other despite different guide sequences due to the narrow spreads of the transcript distributions. In contrast, the sets of three replicates for each of the shRNA conditions have higher intra-set correlation than between shRNA conditions due to the amount of off-target variation for each different shRNA sequence (FIG. 61A, 61B). Furthermore, when the distribution of standard deviations for each guide condition is compared against each shRNA condition across the three transcripts, there is significantly more variation observed in the shRNA conditions ($p<10^{-192}$, 2-sided K-S test) (FIG. 61C).

Figure 62A:
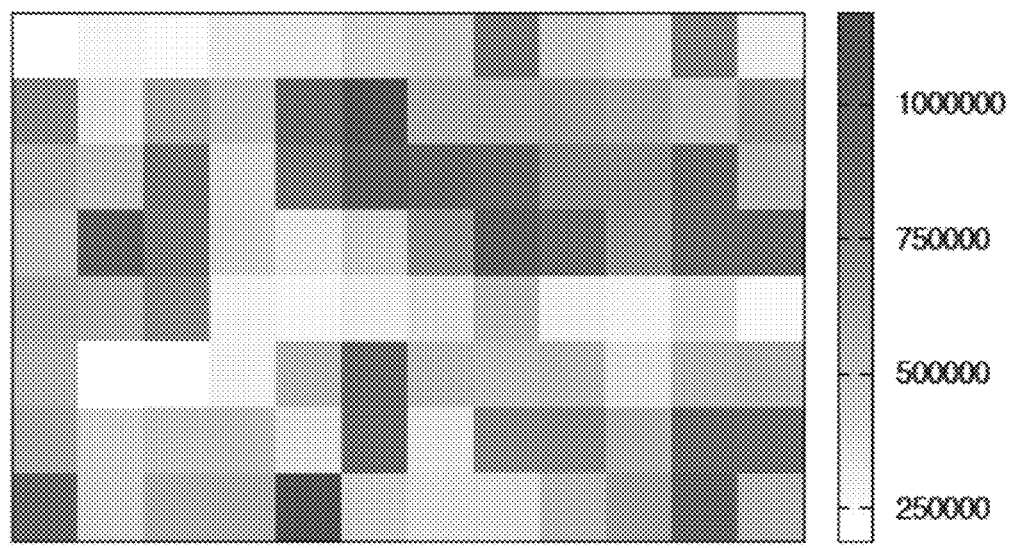
Figure 62B:
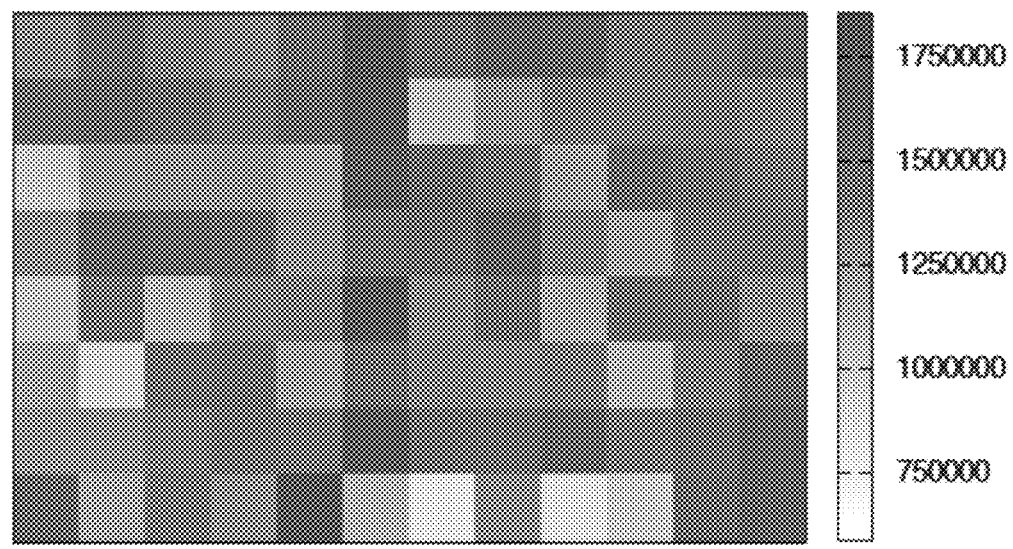
Figures 62C, 62D, 62E, 62F:
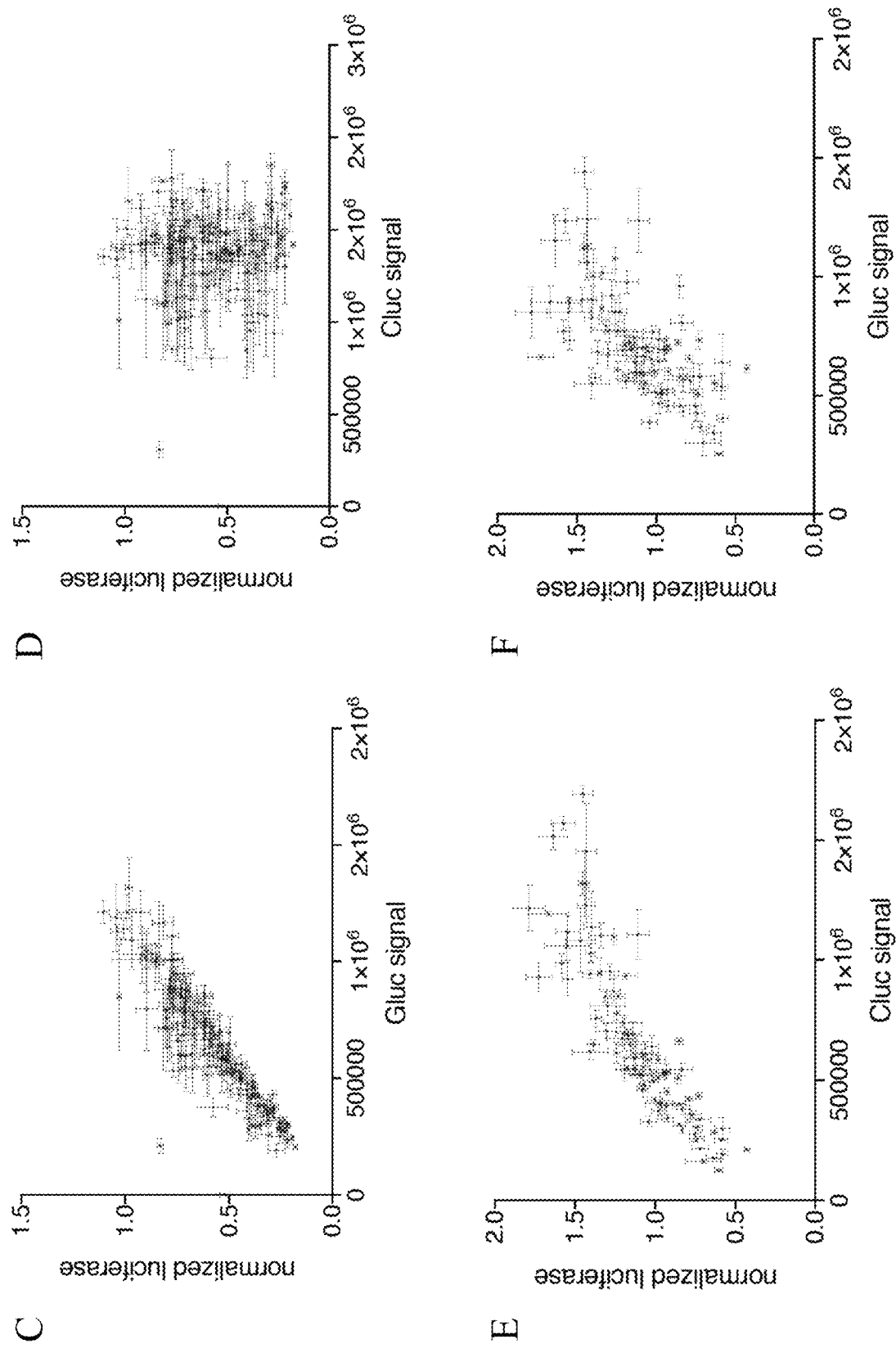
Figures 62G, 62H, 62I, 62J:
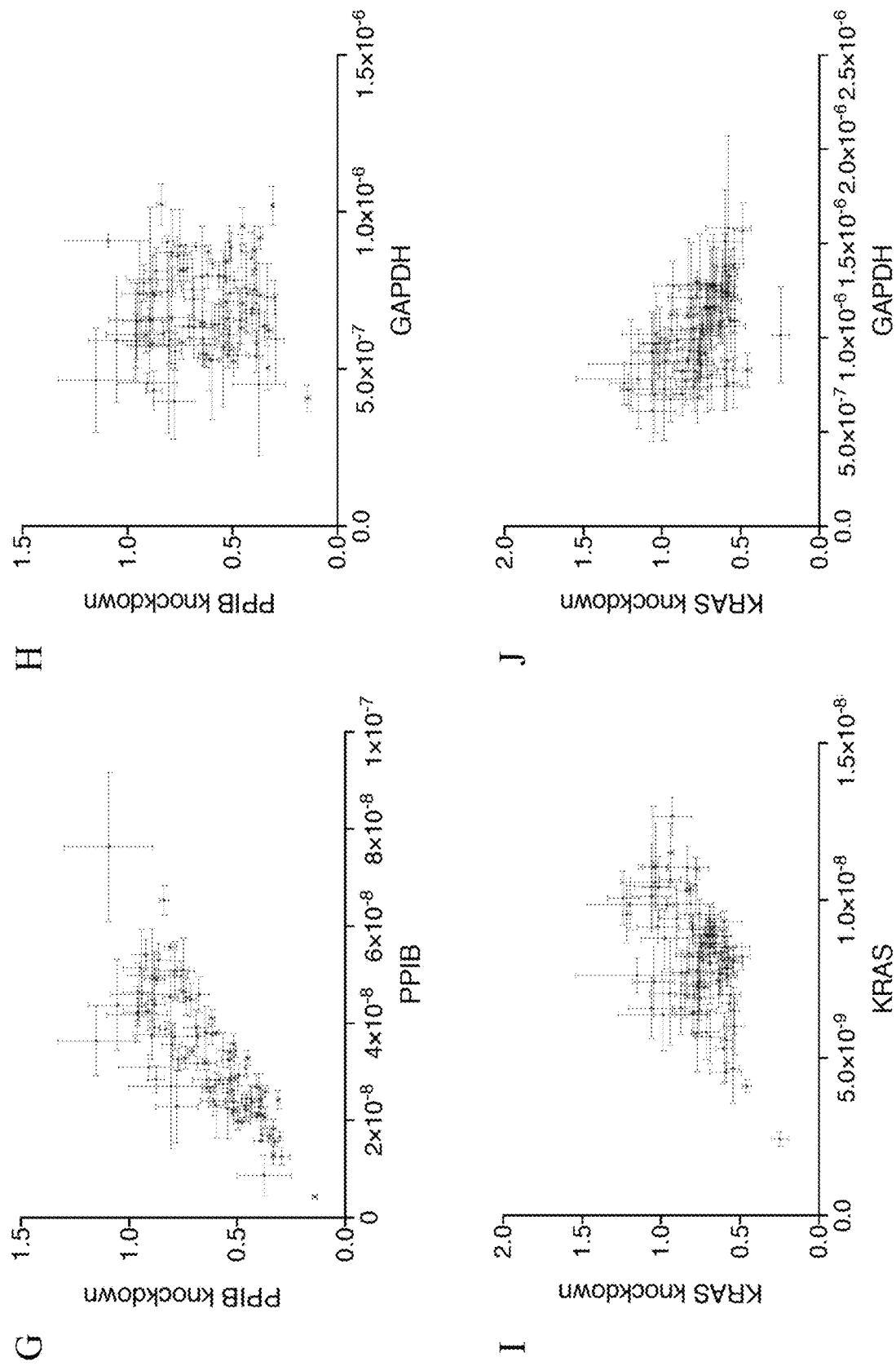

Example 18: LwaCas13a Displays No Observable Collateral Activity in Mammalian Cells The collateral activity of Cas13a has been directly observed biochemically in vitro and indirectly through growth suppression in bacteria. Because the multiplexed leave-one-out and RNA-seq analyses suggested a lack of non-specific RNA degradation and thus collateral activity in mammalian cells, Applicants wanted to see if reduction in global off-target expression due to collateral activity occurred in knockdown experiments. Applicants analyzed the gene controls in the luciferase and endogenous knockdown experiments to see if there was any variation in the controls as a result of target transcript knockdown. From the initial Gluc tiling experiment, it was clear that while many guides displayed significant knockdown of Gluc, there was little variation in Cluc levels (FIG. 62A, 62B). Applicants then decided to analyze the correlations between on-target knockdown to on-target expression or on-target knockdown to off-target expression (the luciferase control or GAPDH in the case of endogenous targeting). Applicants found that for each of the four targets, there was significant positive correlation between on-target knockdown and on-target expression (Gluc: R=0.89, p<0.0001; PPIB: R=0.81, p<0.0001; KRAS: R=0.52, p<0.0001) while much weaker or no correlation between the on-target knockdown and control gene expression (Gluc: R=−0.078, p>0.05; PPIB: R=−0.058, p>0.05; KRAS: R=−0.51, p<0.0001) (FIG. 61C-61J), indicating that there was no detectable off-target knockdown.

Figures 30C, 30D, 30E:
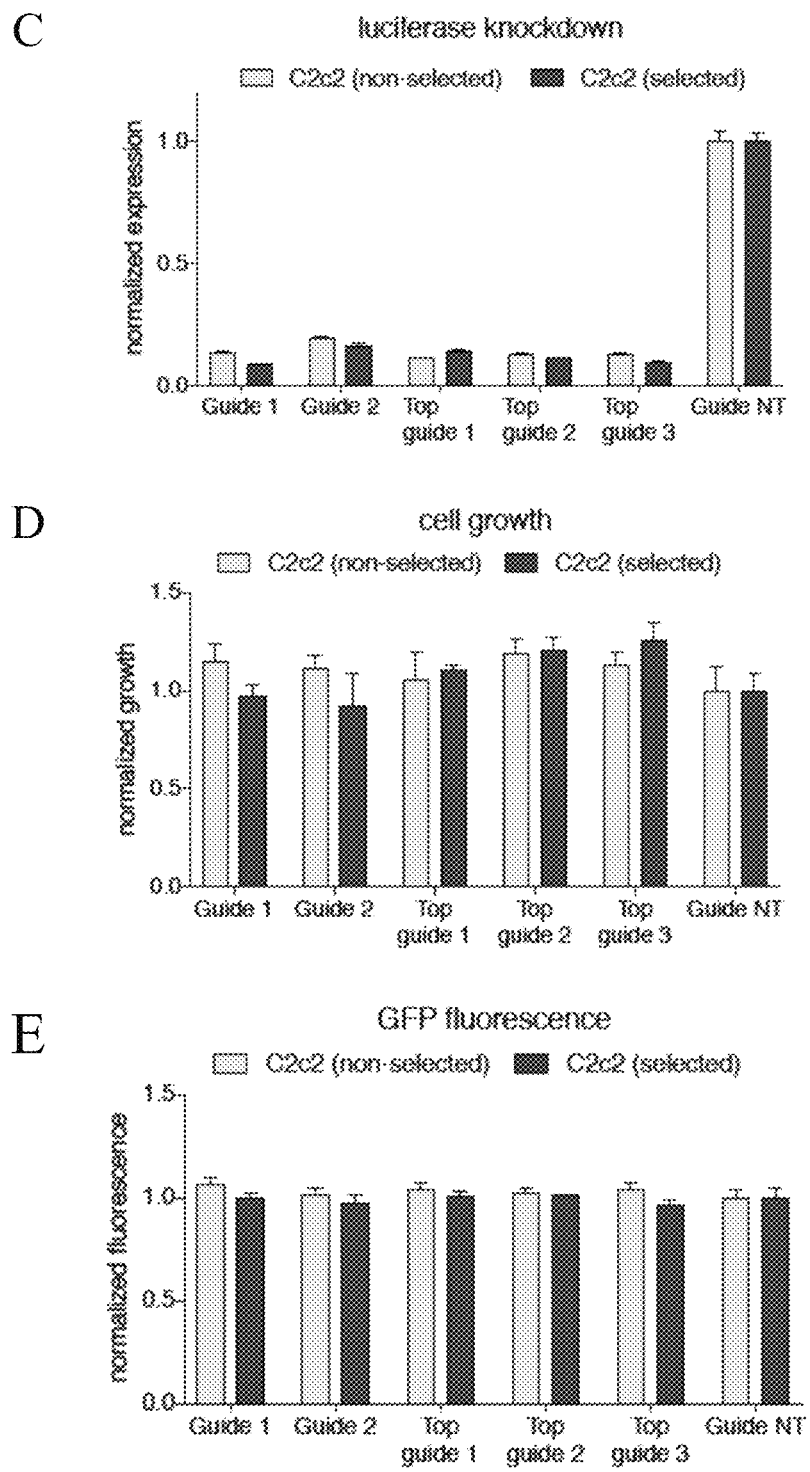

The lack of any significant correlation between control expression and knockdown suggests that there is little or no collateral activity of LwaCas13a in mammalian cells. Applicants wanted to further investigate this by seeing if any growth restriction of cells during transcript knockdown would be seen as previously observed in bacteria (Abudayyeh, O. O. et al. C2c2 is a single-component programmable RNA-guided RNA-targeting CRISPR effector. *Science* 353, aaf5573, doi:10.1126/science.aaf5573 (2016)). Applicants transfected LwaCas13a with multiple guides against Gluc and either with or without selection for 72 hours and then measured knockdown immediately before measuring cell viability and LwaCas13a expression via GFP fluorescence. Applicants observed significant levels of knockdown for all five Gluc targeting guides (FIG. 30C), but no significant differences in cell growth or GFP fluorescence between the targeting guides and a non-targeting guide control (FIG. 30D, 30E).

The collateral activity of Cas13a has been directly observed biochemically in vitro and indirectly through growth suppression in bacteria, but the extent of this activity in mammalian cells is unclear. Applicants saw no sequence-specific off-target LwaCas13a activity in our RNA sequencing experiments, and LwaCas13a-mediated knockdown of targeted transcripts did not affect the growth of mammalian cells expressing similar levels of LwaCas13a (FIG. 29G). Additionally, there were no detectable gene expression changes, indicating that the presence of LwaCas13a targeting does not lead to an observable cell stress response at the transcriptomic level (FIG. 29A, FIG. 60A, 60B) (Subramanian, A. et al. Gene set enrichment analysis: a knowledge-based approach for interpreting genome-wide expression profiles, *Proc. Natl. Acad. Sci USA* 102, 15545-15550 (2005)). In summary, although Applicants cannot rule out the possibility that low levels of uniform collateral activity cleavage may be occurring, Applicants see no detectable collateral activity across the four following observations: 1) in all of our tiling experiments, Applicants observed no significant correlation between target transcript knockdown and the in-line control gene knockdown (FIG. 62), 2) Applicants see minimal disturbance to the transcriptome in our RNA sequencing analysis and no significant off-targets (FIG. 29A), 3) in the leave one-out-multiplexing experiments Applicants do not see knockdown of the excluded gene (FIG. 49L), and 4) Applicants do not see phenotypic effects on cellular growth or stress due to LwaCas13a targeting (FIG. 29G).

Example 19: dCas13a Programmably Binds Transcripts in Mammalian Cells

As a programmable RNA-binding protein could serve as the foundation for a wide range of applications, Applicants explored whether LwaCas13a could be engineered as a catalytically inactive variant (dCas13a). Previous studies have demonstrated that inactivation of LshCas13a via mutation of catalytic residues eliminated RNAse activity, yet maintained RNA-binding (Abudayyeh, O. O. et al. C2c2 is a single-component programmable RNA-guided RNA-targeting CRISPR effector. *Science* 353, aaf5573, doi:10.1126/science.aaf5573 (2016)). Applicants mutated catalytic arginine residues in LwaCas13a to generate dCas13a (FIG. 44A) and found that targeting of dCas13a to a 5' UTR upstream of a reporter coding sequence resulted in reduced translation and reporter gene expression (FIG. 63A). To quantify RNA binding by dCas13a, Applicants performed RNA immunoprecipitation (RIP) (FIG. 58B) using guides containing the 36 nt DR and 28 nt spacers and found that pulldown of dCas13a targeted to either luciferase transcripts (FIG. 44A) or ACTB mRNA (FIG. 63B) resulted in significant enrichment of the corresponding target over non-targeting controls (7.8-11.2× enrichment for luciferase and 2.1 3× enrichment for ACTB; p<0.05), validating dCas13a as a reprogrammable RNA binding protein.

Example 20: Negative Feedback Imaging of Transcripts with dCas13a

Figures 44A, 44B, 44C:
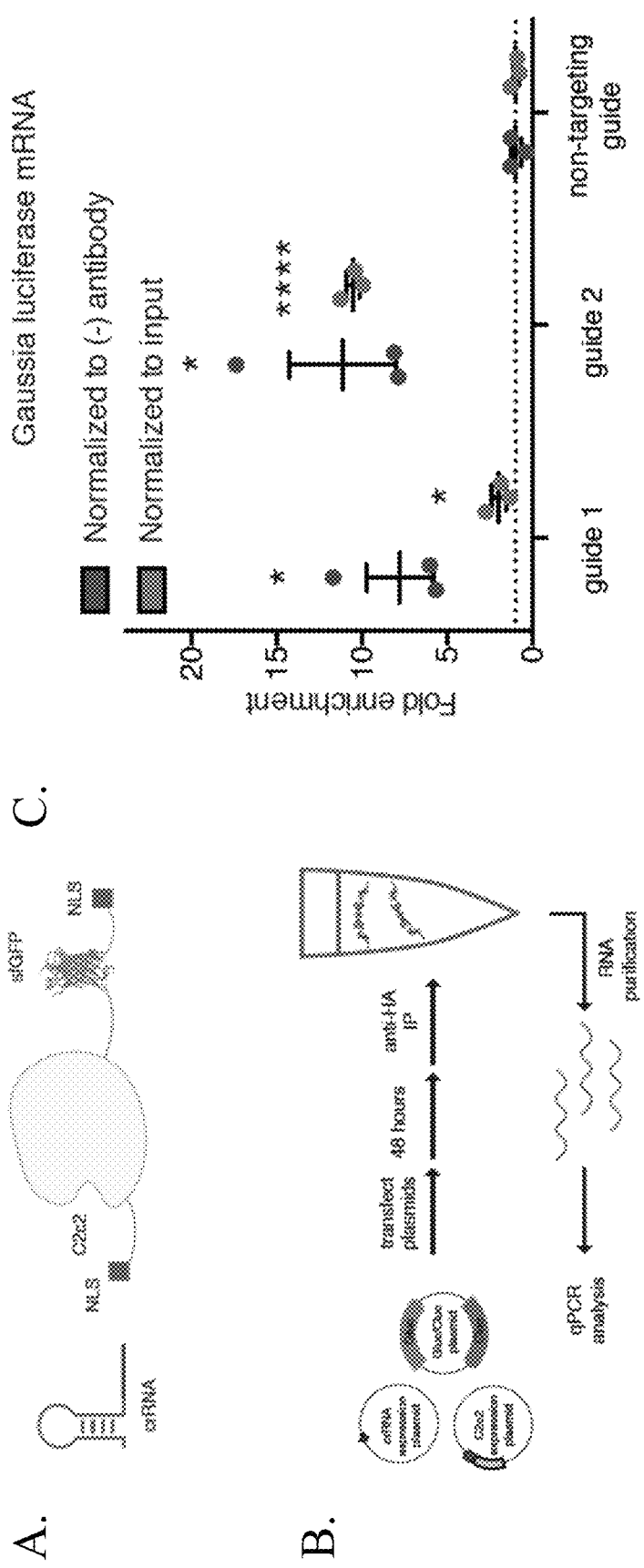
Figure 44D:
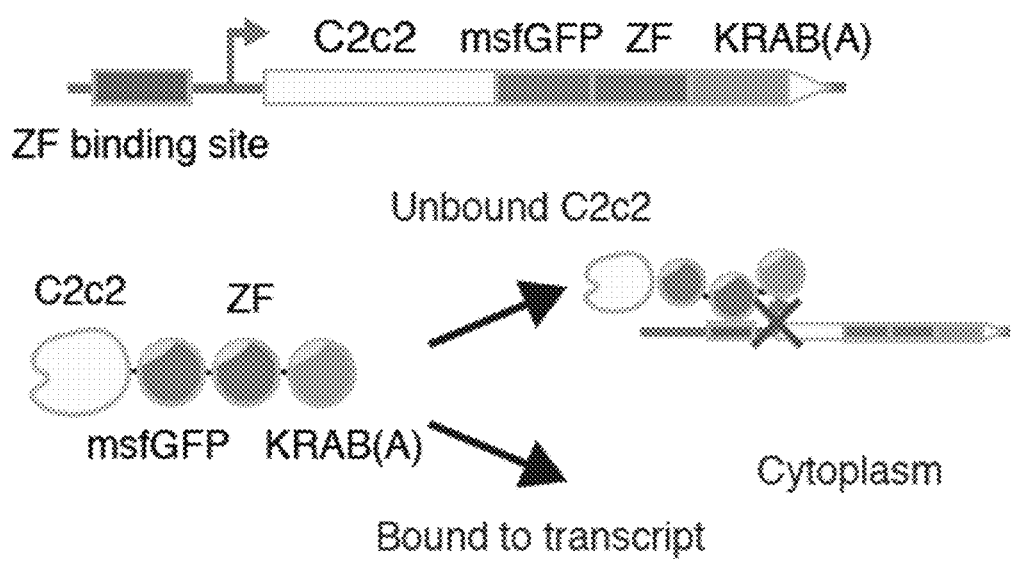
Figure 44E:
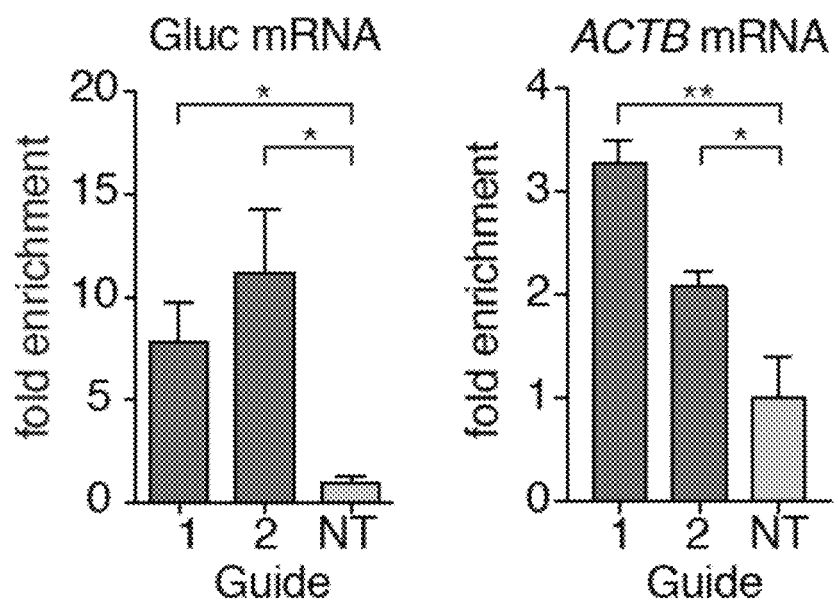
Figure 44F:
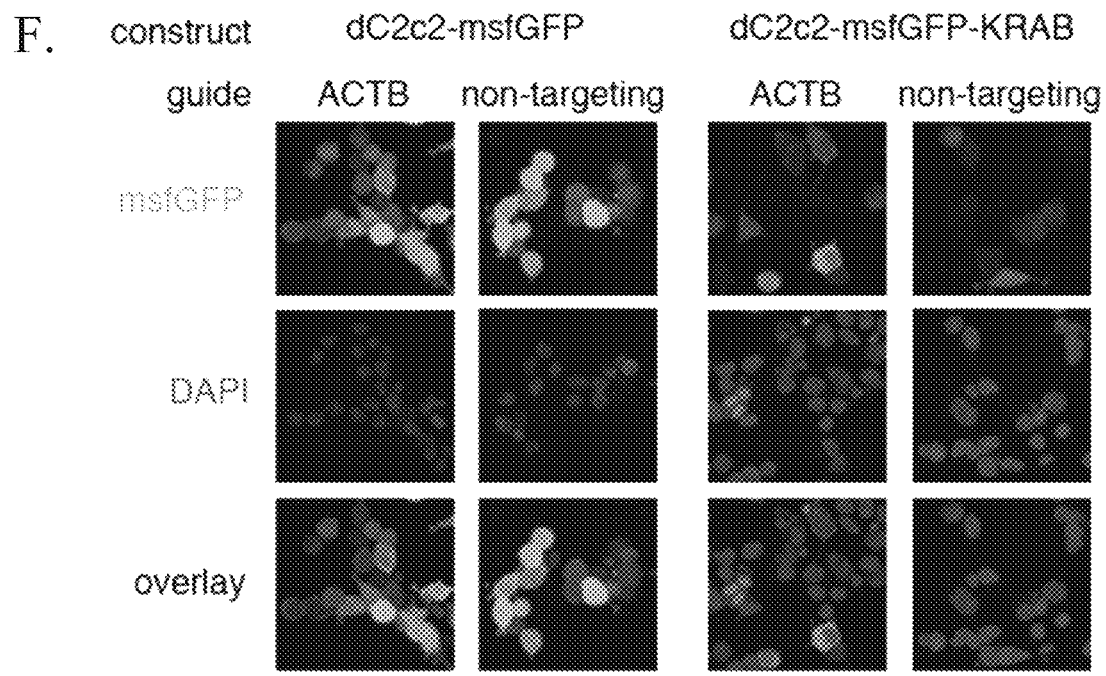
Figure 44G:
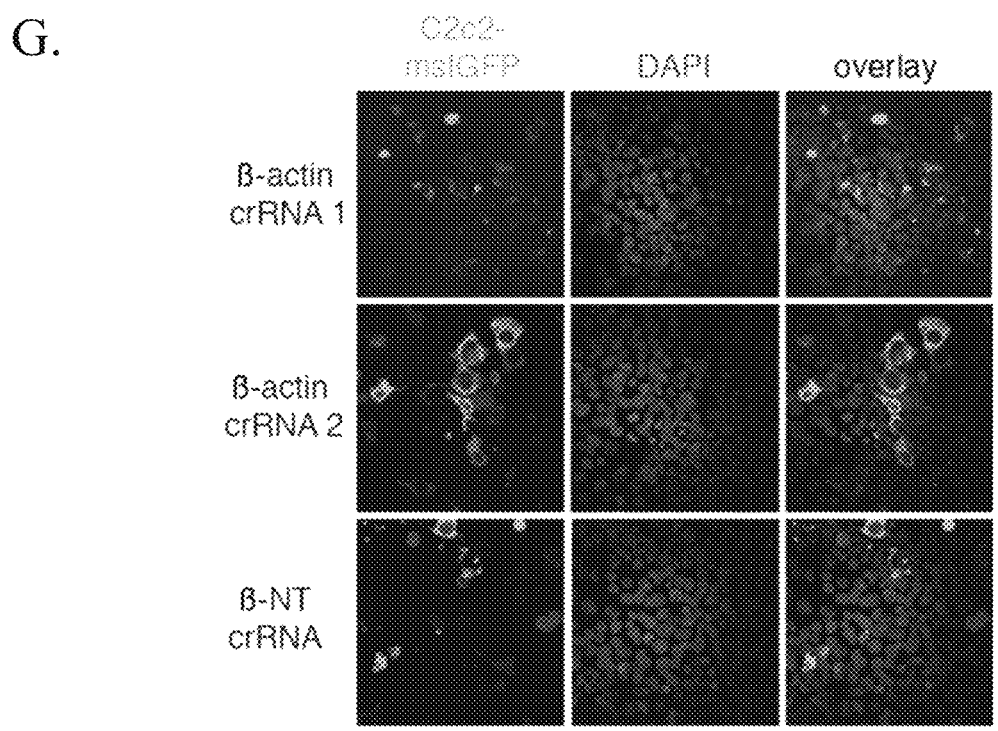
Figures 44H, 44I, 44J, 44K:
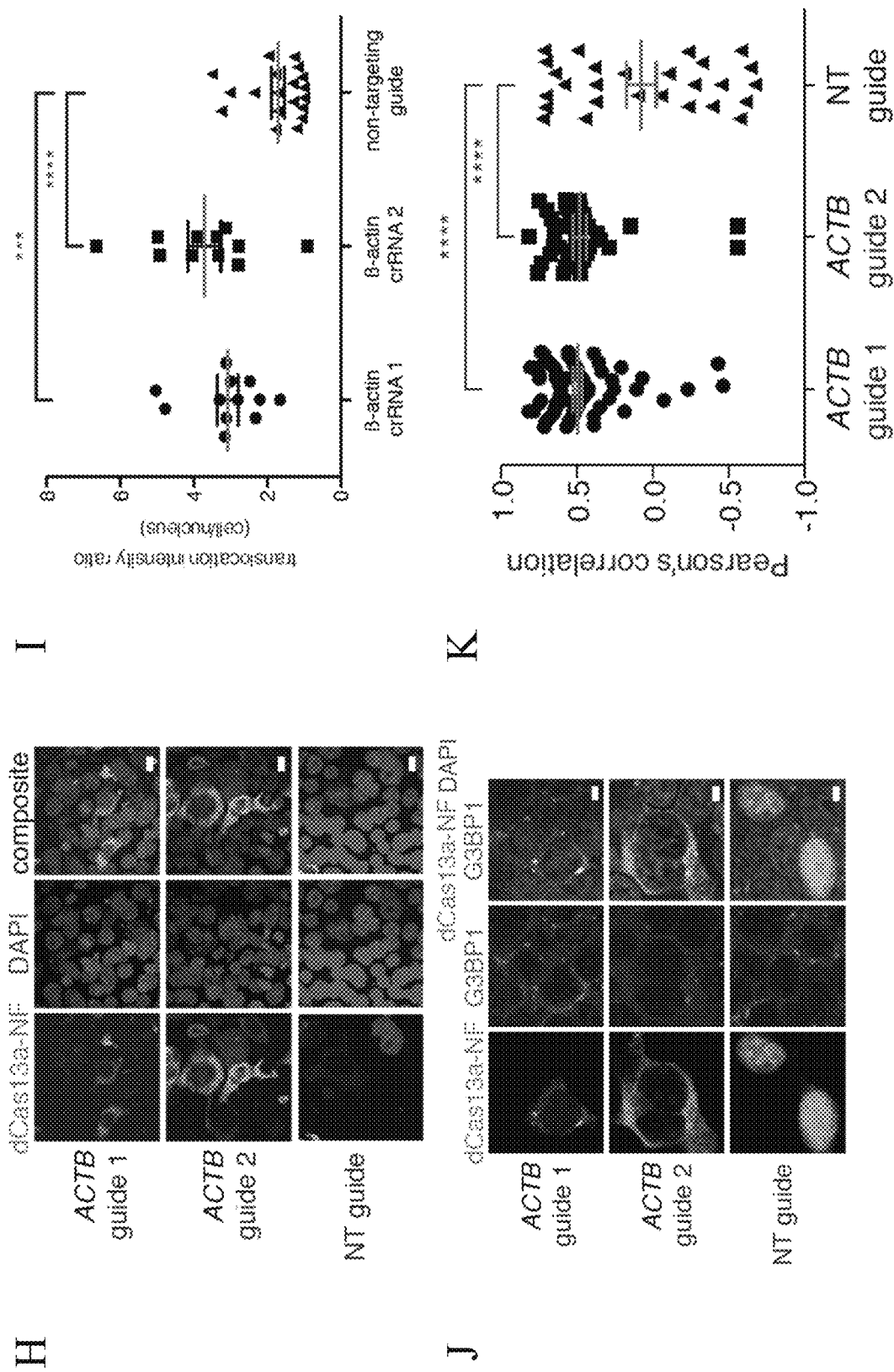
Figure 63D:
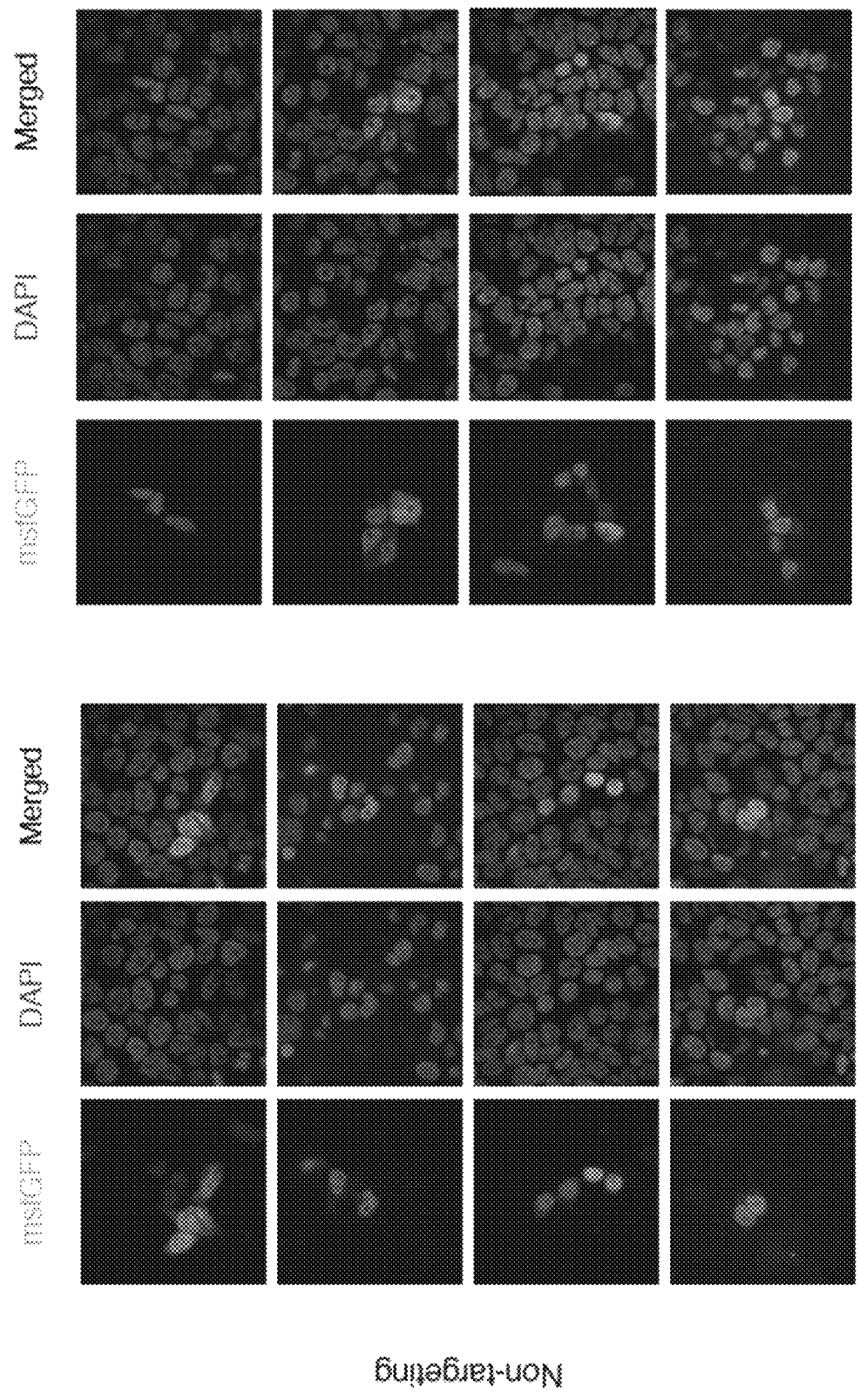
Figure 63E:
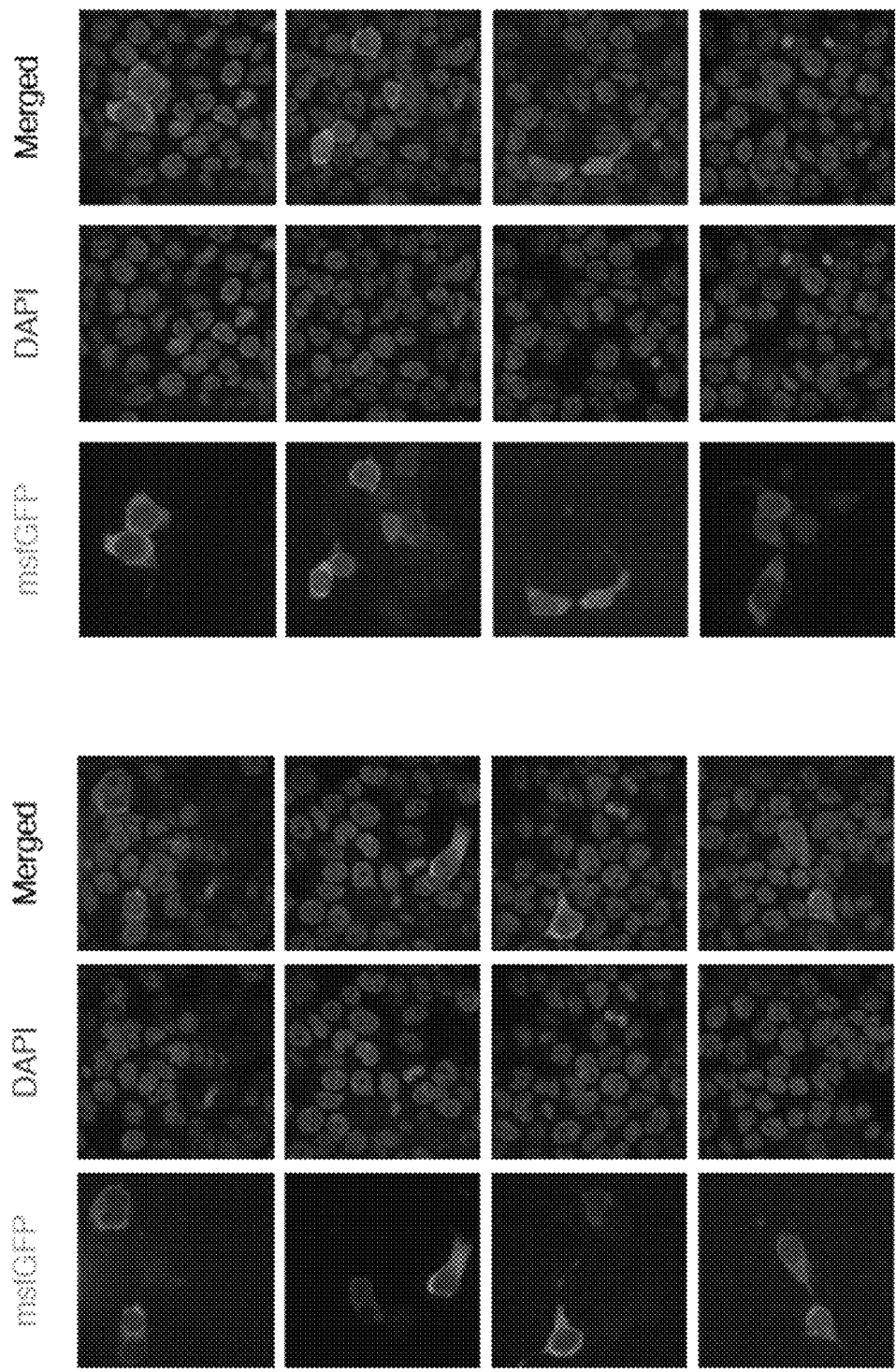
Figure 63F:
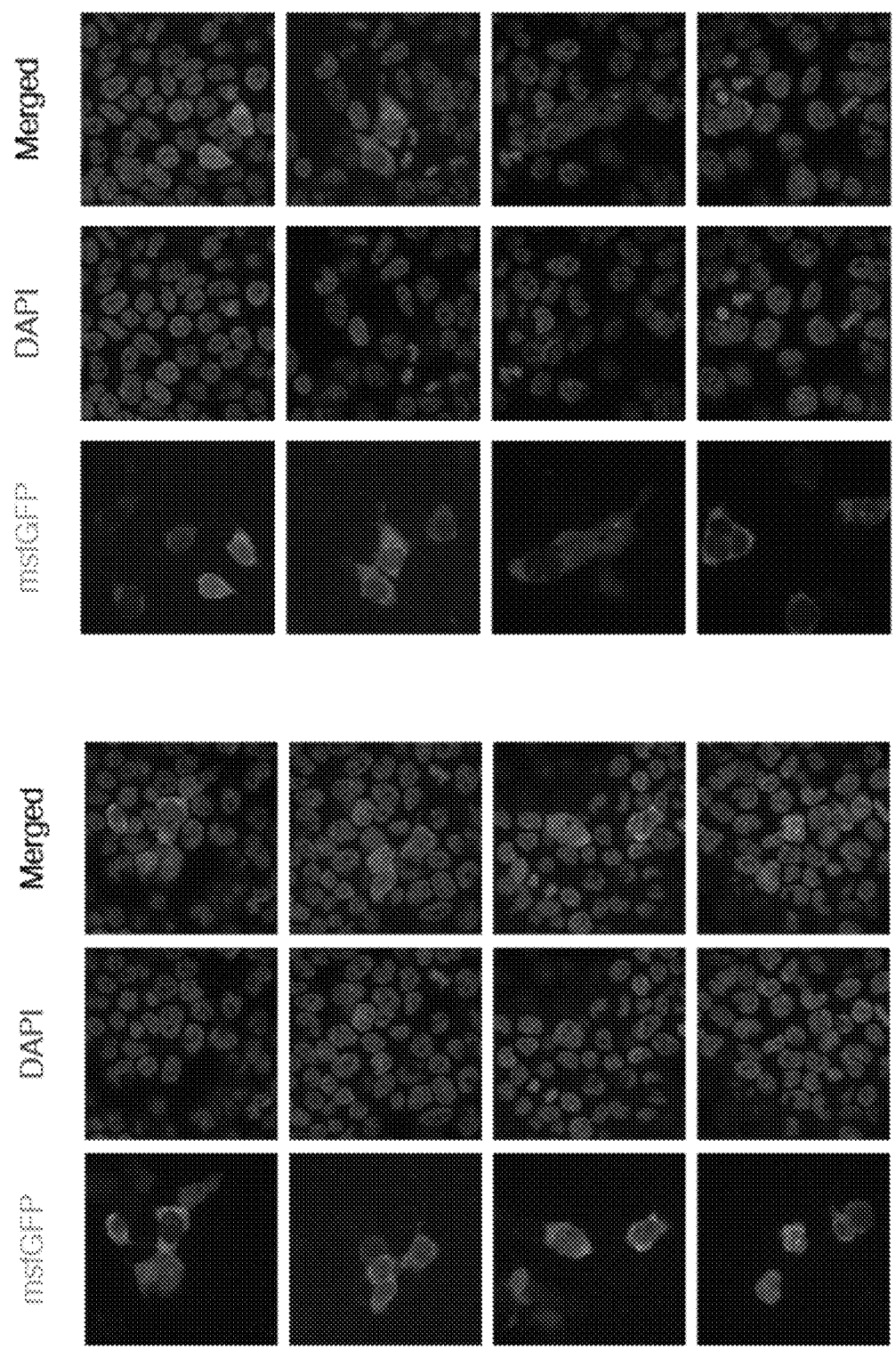

To engineer dCas13a for in vivo imaging and reduce background noise due to unbound protein, Applicants incorporated a negative-feedback system based upon zinc finger self-targeting and KRAB domain repression (Gross, G. G. et al. Recombinant probes for visualizing endogenous synaptic proteins in living neurons. *Neuron* 78, 971-985, doi: 10.1016/j.neuron.2013.04.017 (2013)) (FIG. 44B). Fusing a zinc finger, KRAB domain, and NLS to dCas13a resulted in a negative feedback construct (dCas13a-NF). When dCas13a-NF is not bound to its target transcript, it localizes to nucleus and represses its own expression. Upon transcript binding, dCas13a-NF is exported into the cytoplasm, thereby increasing expression, although it is also possible that newly translated dCas13a-NF remains resident in the cytoplasm. In comparison to dCas13a, which showed modest levels of cytoplasmic translocation (or retention) as a result of transcript binding, dCas13a-NF effectively translocated or re-localized when targeted to ACTB mRNA (FIG. 63E). To further characterize the degree of translocation of dCas13a-NF, Applicants targeted ACTB transcripts with two guides and found that both guides increased translocation compared to a non-targeting guide (3.1-3.7× cellular/nuclear signal ratio; $p<0.0001$) (FIG. 44C, FIG. 11C-11E). Quantification of translocation showed that targeting guides resulted in significantly more fluorescence fraction in the cytoplasm than a non-targeting guide, showing the utility of dCas13a-NF as a transcript imaging tool. To further validate dCas13a-NF imaging, Applicants analyzed the correlation of dCas13a-NF signal to ACTB mRNA fluorescent in situ hybridization (FISH) signal (FIG. 64A) and found that there was significant correlation and signal overlap for the targeting guides versus the non-targeting guide conditions ($R=0.27$ and $0.30$ for guide 1 and 2, respectively, and $R=0.00$ for the non-targeting guide condition; $p<0.0001$ (FIG. 64B).

Example 21: dCas13a Imaging of Stress Granules in Live Cells

Figure 48E:
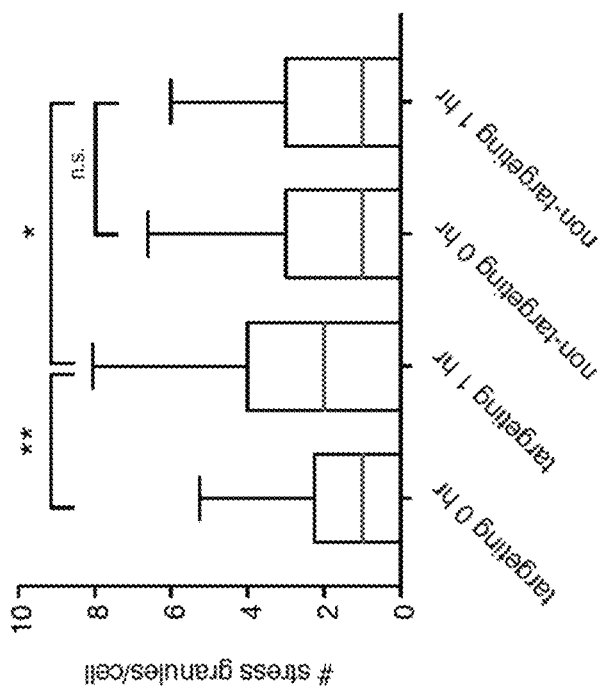
Figure 48F:
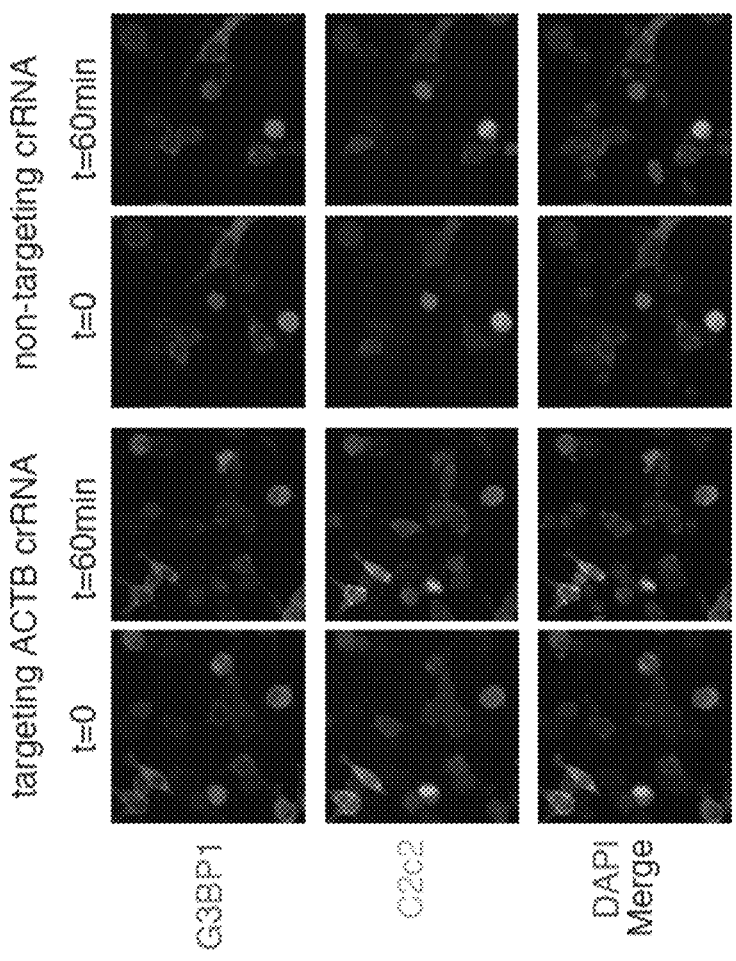

Oxidative stress results in the aggregation of polyadenylated transcripts and proteins into stress granules within the cytoplasm (Nelles, D. A. et al. Programmable RNA Tracking in Live Cells with CRISPR/Cas9. *Cell* 165, 488-496, doi:10.1016/j.cell.2016.02.054 (2016); Unsworth, H., Raguz, S., Edwards, H. J., Higgins, C. F. & Yague, E. mRNA escape from stress granule sequestration is dictated by localization to the endoplasmic reticulum. *FASEBJ*24, 3370-3380, doi:10.1096/fj.09-151142 (2010)), and the development of stress granules has been associated with many pathologies, including cancer, neurodegenerative disease, and myopathies (Wyss-Coray, T. Ageing, neurodegeneration and brain rejuvenation. *Nature* 539, 180-186, doi: 10.1038/nature20411 (2016); Protter, D. S. & Parker, R. Principles and Properties of Stress Granules. *Trends Cell Biol* 26, 668-679, doi:10.1016/j.tcb.2016.05.004 (2016)). Applicants investigated the accumulation of mRNA into stress granules by combining dCas13a-NF imaging of transcripts with visualization of a well known marker of stress granules, G3BP1 (Tourriere, H. et al. The RasGAP-associated endoribonuclease G3BP assembles stress granules. *J Cell Biol* 160, 823-831, doi:10.1083/jcb.200212128 (2003)) (FIG. 48A). To confirm mRNA tracking in fixed samples, Applicants co-transfected either of two ACTB targeting crRNAs or guides with dCas13a-NF, induced stress granule formation with sodium arsenite, and visualized G3BP1 with immunofluoresence (FIG. 48B). dCas13a-NF translocated in or re-localized to the cytoplasm for the targeting conditions as expected, and Applicants found significant correlations between the dCas13a-NF signal and the G3BP1 fluorescence compared to the non-targeting control ($R=0.49$ and $0.50$ for guide 1 and guide 2, respectively, and $0.08$ for the non-targeting guide; $p<0.001$) (FIG. 48C, 48D), suggesting the ability of dCas13a-NF to track stress granule formation. Given co-localization in fixed samples, Applicants next performed stress granule tracking in live cells. Applicants transfected ACTB targeting guide and non-targeting guide with dCas13a-NF, induced stress granule formation with sodium arsenite 24 hours post-transfection, and imaged the live cells over time (FIG. 48E). Using G3BP1-RFP fusion as a stress granule marker, Applicants found that the dCas13a-NF targeted to ACTB localized to significantly more stress granules per cell over time than the corresponding non-targeting control ($p<0.05$) (FIG. 48F).

Example 22: Discussion

The class 2 type VI CRISPR-Cas effector Cas13a can be effectively reprogrammed with crRNAs or guides to knockdown or bind transcripts in mammalian cells. Applicants identified LwaCas13a as the most active of fifteen Cas13a orthologs for RNA cleavage in bacteria and harnessed it for mammalian RNA knockdown with levels comparable to RNAi. Applicants found that there was no detectable PFS through bacterial screening and that guide activity was not influenced by PFS. LwaCas13a is sensitive to mismatches in the spacer:target duplex in vivo, and this sensitivity translates into high specificity of knockdown compared to RNAi. Applicants also showcase unique attributes of LwaCas13a as an RNA knockdown tool, including the ability to further engineer and optimize the protein, multiplexed delivery of guides, and knockdown of nuclear lncRNAs. Importantly, Applicants observe no collateral activity of LwaCas13a, a feature that is highly active in vitro and useful for many applications, such as diagnostics (Gootenberg, J. S. et al. Nucleic acid detection with CRISPR-Cas13a/C2c2. *Science* In press (2017)). Furthermore, Applicants show that LwaCas13a can be rendered catalytically inactive, such that it can be used as a programmable RNA binding platform, and Applicants demonstrate its utility for tracking transcript accumulation in stress granules in live cells.

Importantly, Applicants observe no collateral activity of LwaCas13a in mammalian cells, a feature that Applicants observed in vitro and harnessed for diagnostics applications (Gootenberg, J. S. et al. Nucleic acid detection with CRISPR-Cas13a/C2c2, *Science*, in press (2017)). Collateral activity has been hypothesized to be part of a programmed cell death/dormancy pathway in native bacterial cells, which would remove infected cells from the population or provide infected cells time to adapt and overcome infection, supplementing the on-target viral transcript cleavage activity of Cas13a. The lack of collateral activity in mammalian cells does not preclude the possibility of its existence in the native cellular context.

There are numerous opportunities for refinement and diversification of RNA-targeting tools based upon Cas13 family members. In vivo characterization of additional Cas13 proteins, such as Cas13b (Smargon, A. A. et al. Cas13b Is a Type VI-B CRISPR-Associated RNA-Guided RNase Differentially Regulated by Accessory Proteins Csx27 and Csx28. *Mol Cell* 65, 618-630 e617, doi:10.1016/j.molcel.2016.12.023 (2017)) or Cas13c (Shmakov, S. et al. Diversity and evolution of class 2 CRISPR-Cas systems. Nat Rev Microbiol 15, 169-182, doi:10.1038/nrmicro.2016.184 (2017)), may yield further improvements in cleavage or binding capacity and enable applications requiring orthogonal RNA binding proteins, including multi-color imaging.

Additionally, smaller orthologs would allow for size-constrained delivery options such as Adeno-associated viral vectors (Ran, F. A. et al. In vivo genome editing using *Staphylococcus aureus* Cas9. Nature 520, 186-191, doi: 10.1038/nature14299, nature14299 [pii](2015)). Lastly, exploration of the diversity of Cas13 members coupled with increased structural data (Liu, L. et al. Two Distant Catalytic Sites Are Responsible for C2c2 RNase Activities. *Cell* 168, 121-134 e112, doi:10.1016/j.cell.2016.12.031 (2017)) may allow for either bioinformatics-(Zinn, E. et al. In Silico Reconstruction of the Viral Evolutionary Lineage Yields a Potent Gene Therapy Vector. *Cell Rep* 12, 1056-1068, doi:10.1016/j.celrep.2015.07.019 (2015)) or structure- (Kleinstiver, B. P. et al. High-fidelity CRISPR-Cas9 nucleases with no detectable genome-wide off-target effects. *Nature* 529, 490-495, doi:10.1038/nature16526 (2016); Slaymaker, I. M. et al. Rationally engineered Cas9 nucleases with improved specificity. *Science* 351, 84-88, doi:10.1126/science.aad5227 (2016)) guided rational design. Improved RNA binding tools will allow additional functionalizations, including imaging via reconstitution of split fluorophores (Ozawa, T., Natori, Y., Sato, M. & Umezawa, Y. Imaging dynamics of endogenous mitochondrial RNA in single living cells. *Nat Methods* 4, 413-419, doi:10.1038/nmeth1030 (2007)), translational modulation (De Gregorio, E., Preiss, T. & Hentze, M. W. Translation driven by an eIF4G core domain in vivo. *EMBO J* 18, 4865-4874, doi:10.1093/emboj/18.17.4865 (1999); Adamala, K. P., Martin-Alarcon, D. A. & Boyden, E. S. Programmable RNA-binding protein composed of repeats of a single modular unit. *Proc Natl Acad Sci USA* 113, E2579-2588, doi:10.1073/pnas.1519368113 (2016); Campbell, Z. T., Valley, C. T. & Wickens, M. A protein-RNA specificity code enables targeted activation of an endogenous human transcript. *Nat Struct Mol Biol* 21, 732-738, doi:10.1038/nsmb.2847 (2014); Cao, J. et al. Light-inducible activation of target mRNA translation in mammalian cells. *Chem Commun (Camb)* 49, 8338-8340, doi:10.1039/c3cc44866e (2013); Cooke, A., Prigge, A., Opperman, L. & Wickens, M. Targeted translational regulation using the PUF protein family scaffold. *Proc Natl Acad Sci USA* 108, 15870-15875, doi: 10.1073/pnas.1105151108 (2011)), RNA base editing (Nishikura, K. A-to-I editing of coding and non-coding RNAs by ADARs. *Nat Rev Mol Cell Biol* 17, 83-96, doi:10.1038/nrm.2015.4 (2016); Wedekind, J. E., Dance, G. S., Sowden, M. P. & Smith, H. C. Messenger RNA editing in mammals: new members of the APOBEC family seeking roles in the family business. *Trends Genet* 19, 207-216, doi:10.1016/S0168-9525(03)00054-4 (2003)), epitranscriptomic perturbation (Harcourt, E. M., Kietrys, A. M. & Kool, E. T. Chemical and structural effects of base modifications in messenger RNA. Nature 541, 339-346, doi:10.1038/nature21351 (2017)), targeted induction of apoptosis based on RNA expression levels (Rider, T. H. et al. Broad-spectrum antiviral therapeutics. *PLoS One* 6, e22572, doi:10.1371/journal.pone.0022572 (2011)), or splicing modulation (Wang, Y., Cheong, C. G., Hall, T. M. & Wang, Z. Engineering splicing factors with designed specificities. *Nat Methods* 6, 825-830, doi:10.1038/nmeth.1379 (2009)).

RNA knockdown with Cas13a can be applied to perturbing RNAs in multiple biological contexts, including genome-wide pooled knockdown screening, interrogation of lncRNA and nascent transcript function, allele-specific knockdown, and RNA viral therapeutics. In addition, dCas13a and derivatives enable RNA pulldown to study RNA-protein interactions, tracking of transcripts in live cells, and targeted destruction of cells based on RNA levels, which would be useful for studying specific cell populations or killing cancerous cells. Applicants have shown Cas13 to be a robust platform for both programmable knockdown and binding of RNAs in mammalian and plant cells, and this platform may be extended to other eukaryotic organisms. CRISPR-Cas13 coupled with creative engineering approaches will be a powerful platform for nucleic acid based diagnostics and therapeutics and can usher a revolution for studying the transcriptome.

Example 23: Split Designs for Apoptosis

It is often desirable to deplete or kill cells based on transcriptional signatures or specific gene expression, either for basic biology applications to study the role of specific cells types or for therapeutic applications such as cancer or senescent cell clearance (Baker, D. J., Childs, B. G., Durik, M., Wijers, M. E., Sieben, C. J., Zhong, J., Saltness, R. A., Jeganathan, K. B., Verzosa, G. C., Pezeshki, A., et al. (2016). Naturally occurring p16(Ink4a)-positive cells shorten healthy lifespan. Nature 530, 184-189.). This targeted cell killing can be achieved by fusing split apoptotic domains to Cas13 proteins, which upon binding to the transcript are reconstituted, leading to death of cells specifically expressing targeted genes or sets of genes. In certain embodiments, the apoptotic domains may be split Caspase 3 (Chelur, D. S., and Chalfie, M. (2007). Targeted cell killing by reconstituted caspases. Proc. Natl. Acad. Sci. U.S.A. 104, 2283-2288.). Other possibilities are the assembly of Caspases, such as bringing two Caspase 8 (Pajvani, U. B., Trujillo, M. E., Combs, T. P., Iyengar, P., Jelicks, L., Roth, K. A., Kitsis, R. N., and Scherer, P. E. (2005). Fat apoptosis through targeted activation of caspase 8: a new mouse model of inducible and reversible lipoatrophy. Nat. Med. 11, 797-803.) or Caspase 9 (Straathof, K. C., Pule, M. A., Yotnda, P., Dotti, G., Vanin, E. F., Brenner, M. K., Heslop, H. E., Spencer, D. M., and Rooney, C. M. (2005). An inducible caspase 9 safety switch for T-cell therapy. Blood 105, 4247-4254.) effectors in proximity via Cas13 binding. It is also possible to reconstitute a split TEV (Gray, D. C., Mahrus, S., and Wells, J. A. (2010). Activation of specific apoptotic caspases with an engineered small-molecule-activated protease. Cell 142, 637-646.) via Cas13 binding on a transcript. This split TEV can be used in a variety of readouts, including luminescent and fluorescent readouts (Wehr, M. C., Laage, R., Bolz, U., Fischer, T. M., Grunewald, S., Scheek, S., Bach, A., Nave, K.-A., and Rossner, M. J. (2006). Monitoring regulated protein-protein interactions using split TEV. Nat. Methods 3, 985-993.). One embodiment involves the reconstitution of this split TEV to cleave modified pro-caspase 3 or pro-caspase 7 (Gray, D. C., Mahrus, S., and Wells, J. A. (2010). Activation of specific apoptotic caspases with an engineered small-molecule-activated protease. Cell 142, 637-646), resulting in cell death.

Example 24: Split Designs for Imaging

While mentioned in the current application, additional split-fluorophore constructs were designed for imaging with reduced background via reconstitution of a split fluorophore upon binding of 2 Cas13 proteins to a transcript. These split proteins include iSplit (Filonov, G. S., and Verkhusha, V.V. (2013). *A near-infrared BiFC reporter for in vivo imaging of protein-protein interactions. Chem. Biol.* 20, 1078-1086.), Split Venus (Wu, B., Chen, J., and Singer, R. H. (2014). *Background free imaging of single mRNAs in live cells using split fluorescent proteins. Sci. Rep.* 4, 3615.), and Split superpositive GFP (Blakeley, B. D., Chapman, A. M., andMcNaughton, B. R. (2012). *Split-superpositive GFP reassembly is a fast, efficient, and robust method for detecting protein-protein interactions in vivo. Mol. Biosyst.* 8, 2036-2040.).

Example 25: Split Designs for Additional Transcriptional Activity, Luciferase

Additional possible split fusions that could be constituted by Cas13 proteins could include luciferase for luminescent imaging (Kim, S. B., Ozawa, T., Watanabe, S., and Umezawa, Y. (2004). *High-throughput sensing and noninvasive imaging of protein nuclear transport by using reconstitution of split Renilla luciferase. Proc. Natl. Acad. Sci. U.S.A.* 101, 11542-11547.) or split transcription factors to drive expression of genes of genetic circuits in an RNA-sensing based manner. Possible split transcription factors include split-ubiquitin based systems, such as the split-ubiquitin-LexA system (Petschnigg, J., Groisman, B., Kotlyar, M., Taipale, M., Zheng, Y., Kurat, C. F., Sayad, A., Sierra, J R., Mattiazzi Usaj, M., Snider, J., et al. (2014). *The mammalian-membrane two-hybrid assay (MaMTH) for probing membrane-protein interactions in human cells. Nat. Methods* 11, 585-592.)

Example 26: Identification of C2c2 Orthologs

The following C2c2 orthologues may be codon optimized for expression in mammalian cells.

| C2c2 orthologue | Code | Multi Letter |
|---|---|---|
| *Leptotrichia buccalis* C-1013-b | C2-17 | Lbu |
| *Herbinix hemicellulosilytica* | C2-18 | Hhe |
| [*Eubacterium*] *rectale* | C2-19 | Ere |
| Eubacteriaceae bacterium CHKCI004 | C2-20 | Eba |
| *Blautia* sp. *Marseille*-P2398 | C2-21 | BSm |
| *Leptotrichia* sp. *oral taxon 879 str. F0557* | C2-22 | Lsp |
| Lachnospiraceae bacterium NK4A144 | C2-23 | NK4A144 |
| RNA-binding protein S1 *Chloroflexus aggregans* | C2-24 | |
| *Demequina aurantiaca* | C2-25 | |
| *Thalassospira* sp. TSL5-1 | C2-26 | |
| SAMN04487830_13920 *Pseudobutyrivibrio* sp. OR37 | C2-27 | |
| SAMN02910398_00008 *Butyrivibrio* sp. YAB3001 | C2-28 | |
| *Blautia* sp. *Marseille*-P2398 | C2-29 | |
| *Leptotrichia* sp. *Marseille*-P3007 | C2-30 | |
| *Bacteroides ihuae* | C2-31 | |
| SAMN05216357_1045 Porphyromonadaceae bacterium KH3CP3RA | C2-32 | |
| *Listeria riparia* | C2-33 | |
| *Insolitispirillum peregrinum* | C2-34 | |

The protein sequences of the above species are listed in the Table below.

C2-17 *Leptotrichia buccalis* C-1013-b

MKVTKVGGISHKKYTSEGRLVKSESEENRTDERLSALLNMRLDM
YIKNPSSTETKENQKRIGKLKKFFSNKMVYLKDNTLSLKNGKKENI
DREYSETDILESDVRDKKNFAVLKKIYLNENVNSEELEVFRNDIKK
KLNKINSLKYSFEKNKANYQKINENNIEKVEGKSKRNIIYDYYRES
AKRDAYVSNVKEAFDKLYKEEDIAKLVLEIENLTKLEKYKIREFYH
EIIGRKNDKENFAKIIYEEIQNVNNMKELIEKVPDMSELKKSQVFY
KYYLDKEELNDKNIKYAFCHFVEIEMSQLLKNYVYKRLSNISNDKI
KRIFEYQNLKKLIENKLLNKLDTYVRNCGKYNYYLQDGEIATSDFI
ARNRQNEAFLRNIIGVSSVAYFSLRNILETENENDITGRMRGKTVK
NNKGEEKYVSGEVDKIYNENKKNEVKENLKMFYSYDFNMDNKN
EIEDFFANIDEAISSIRHGIVHFNLELEGKDIFAFKNIAPSEISKKMFQ
NEINEKKLKLKIFRQLNSANVPRYLEKYKILNYLKRTRFEFVNKNIP
FVPSFTKLYSRIDDLKNSLGIYWKTPKTNDDNKTKEIIDAQIYLLKN
IYYGEFLNYFMSNNGNFFEISKEIIELNKNDKRNLKTGFYKLQKFE
DIQEKIPKEYLANIQSLYMINAGNQDEEEKDTYIDFIQKIFLKGFMT
YLANNGRLSLIYIGSDEETNTSLAEKKQEFDKFLKKYEQNNNIKIPY
EINEFLREIKLGNILKYTERLNMFYLILKLLNHKELTNLKGSLEKYQ
SANKEEAFSDQLELINLLNLDNNRVTEDFELEADEIGKFLDFNGNK
VKDNKELKKFDTNKIYFDGENIIKHRAFYNIKKYGMLNLLEKIADK
AGYKISIEELKKYSNKKNEIEKNHKMQENLHRKYARPRKDEKFTD
EDYESYKQAIENIEEYTHLKNKVEFNELNLLQGLLLRILHRLVGYT
SIWERDLRFRLKGEFPENQYIEEIFNFENKKNVKYKGGQIVEKYIKF
YKELHQNDEVKINKYSSANIKVLKQEKKDLYIRNYIAHFNYIPHAE
ISLLEVLENLRKLLSYDRKLKNAVMKSVVDILKEYGFVATFKIGAD
KKIGIQTLESEKIVHLKNLKKKKLMTDRNSEELCKLVKIMFEYKME
EKKSEN (SEQ ID NO: 74)

C2-18 *Herbinix hemicellulosilytica*

MKLTRRRISGNSVDQKITAAFYRDMSQGLLYYDSEDNDCTDKVIE
SMDFERSWRGRILKNGEDDKNPFYMFVKGLVGSNDKIVCEPIDVD
SDPDNLDILINKNLTGFGRNLKAPDSNDTLENLIRKIQAGIPEEEVLP
ELKKIKEMIQKDIVNRKEQLLKSIKNNRIPFSLEGSKLVPSTKKMK
WLFKLIDVPNKTFNEKMLEKYWEIYDYDKLKANITNRLDKTDKK
ARSISRAVSEELREYHKNLRTNYNRFVSGDRPAAGLDNGGSAKYN
PDKEEFLLFLKEVEQYFKKYFPVKSKHSNKSKDKSLVDKYKNYCS
YKVVKKEVNRSIINQLVAGLIQQGKLLYYFYYNDTWQEDFLNSYG
LSYIQVEEAFKKSVMTSLSWGINRLTSFFIDDSNTVKFDDITTKKAK
EAIESNYFNKLRTCSRMQDHFKEKLAFFYPVYVKDKKDRPDDDIE
NLIVLVKNAIESVSYLRNRTFHFKESSLLELLKELDDKNSGQNKID
YSVAAEFIKRDJENLYDVFREQIRSLGIAEYYKADMISDCFKTCGLE
FALYSPKNSLMPAFKNVYKRGANLNKAYIRDKGPKETGDQGQNS
YKALEEYRELTWYIEVKNNDQSYNAYKNLLQLIYYHAFLPEVREN
EALITDPINRTKEWNRKETEERLNTKNNKKHKNFDENDDITVNTY
RYESIPDYQGESLDDYLKVLQRKQMARAKEVNEKEEGNNNYIQFI
RDVVVWAFGAYLENKLKNYKNELQPPLSKENIGLNDTLKELFPEE
KVKSPFNIKCRFSISTFIDNKGKSTDNTSAEAVKTDGKEDEKDKKNI

-continued

```
                          KRKDLLCFYLFLRLLDENEICKLQHQFIKYRCSLKERRFPGNRTKL
                          EKETELLAELEELMELVRFTMPSIPEISAKAESGYDTMIKKYFKDFI
                          EKKVFKNPKTSNLYYHSDSKTPVTRKYMALLMRSAPLHLYKDIFK
                          GYYLITKKECLEYIKLSNIIKDYQNSLNELHEQLERIKLKSEKQNGK
                          DSLYLDKKDFYKVKEYVENLEQVARYKHLQHKINFESLYRIFRIH
                          VDIAARMVGYTQDWERDMHFLFKALVYNGVLEERRFEAIFNNNND
                          DNNDGRIVKKIQNNLNNKNRELVSMLCWNKKLNKNEFGAIIWKR
                          NPIAHLNHFTQTEQNSKSSLESLINSLRILLAYDRKRQNAVTKTIND
                          LLLNDYHIRIKWEGRVDEGQIYFNIKEKEDTENEPIIHLKHLHKKDC
                          YIYKNSYMFDKQKEWICNGIKEEVYDKSILKCIGNLFKFDYEDKN
                          KSSANPKHT (SEQ ID NO: 75)

C2-19   [Eubacterium]     MLRRDKEVKKLYNVFNQIQVGTKPKKWNNDEKLSPEENERRAQQ
        rectale           KNIKMKNYKWREACSKYVESSQRIINDVIFYSYRKAKNKLRYMRK
                          NEDILKKMQEAEKLSKFSGGKLEDFVAYTLRKSLVVSKYDTQEFD
                          SLAAMVVFLECIGKNNISDHEREIVCKLLELIRKDFSKLDPNVKGS
                          QGANIVRSVRNQNMIVQPQGDRFLFPQVYAKENETVTNKNVEKE
                          GLNEFLLNYANLDDEKRAESLRKLRRILDVYFSAPNHYEKDMDIT
                          LSDNIEKEKFNVWEKHECGKKETGLFVDIPDVLMEAEAENIKLDA
                          VVEKRERKVLNDRVRKQNIICYRYTRAVVEKYNSNEPLFFENNAI
                          NQYWIHHIENAVERILKNCKAGKLFKLRKGYLAEKVWKDAINLISI
                          KYIALGKAVYNFALDDIWKDKKNKELGIVDERIRNGITSFDYEMIK
                          AHENLQRELAVDIAFSVNNLARAVCDMSNLGNKESDFLLWKRND
                          IADKLKNKDDMASVSAVLQFFGGKSSWDINIFKDAYKGKKKYNY
                          EVRFIDDLRKAIYCARNENFHFKTALVNDEKWNTELFGKIFERETE
                          FCLNVEKDRFYSNNLYMFYQVSELRNMLDHLYSRSVSRAAQVPS
                          YNSVIVRTAFPEYITNVLGYQKPSYDADTLGKWYSACYYLLKEIY
                          YNSPFLQSDRALQLFEKSVKTLSWDDKKQQRAVDNFKDHFSDIKSA
                          CTSLAQVCQIYMTEYNQQNNQIKKVRSSNDSIFDQPVYQHYKVLL
                          KKAIANAFADYLKNNKDLFGFIGKPFKANEIREIDKEQFLPDWTSR
                          KYEALCIEVSGSQELQKWYIVGKFLNARSLNLMVGSMRSYIQYVT
                          DIKRRAASIGNELHVSVHDVEKVEKVVVQVIEVCSLLASRTSNQFE
                          DYFNDKDDYARYLKSYVDFSNVDMPSEYSALVDFSNEEQSDLYV
                          DPKNPKVNRNIVHSKLFAADHILRDIVEPVSKDNIEEFYSQKAEIAY
                          CKIKGKEITAEEQKAVLKYQKLKNRVELRDIVEYGEIINELLGQLIN
                          WSFMRERDLLYFQLGFHYDCLRNDSKKPEGYKNIKVDENSIKDAI
                          LYQIIGMYVNGVTVYAPEKDGDKLKEQCVKGGVGVKVSAFHRYS
                          KYLGLNEKTLYNAGLEIFEVVAEHEDIINLRNGIDHFKYYLGDYRS
                          MLSIYSEVFDRFFTYDIKYQKNVLNLLQNILLRHNVIVEPILESGFK
                          TIGEQTKPGAKLSIRSIKSDTFQYKVKGGTLITDAKDERYLETIRKIL
                          YYAENEEDNLKKSVVVTNADKYEKNKESDDQNKQKEKKNKDNK
                          GKKNEETKSDAEKNNNERLSYNPFANLNFKLSN (SEQ ID NO: 76)

C2-20   Eubacteriaceae    MKISKESHKRTAVAVMEDRVGGVVYVPGGSGIDLSNNLKKRSMD
        bacterium         TKSLYNVFNQIQAGTAPSEYEWKDYLSEAENKKREAQKMIQKAN
        CHKCI004          YELRRECEDYAKKANLAVSRIIFSKKPKKIFSDDDIISHMKKQRLSK
                          FKGRMEDFVLIALRKSLVVSTYNQEVFDSRKAATVFLKNIGKKNIS
                          ADDERQIKQLMALIREDYDKWNPDKDSSDKKESSGTKVIRSIEHQ
                          NMVIQPEKNKLSLSKISNVGKKTKTKQKEKAGLDAFLKEYAQIDE
                          NSRMEYLKKLRRLLDTYFAAPSSYIKGAAVSLPEMNFSSELNVWE
                          RHEAAKKVNINFVEIPESLLNAEQNNNKINKVEQEHSLEQLRTDIR
                          RRNITCYHFANALAADERYHTLFFENMAMNQFWIHHMENAVERI
                          LKKCNVGTLFKLRIGYLSEKVWKDMLNLLSIKYIALGKAVYHFAL
                          DDIWKADIWKDASDKNSGKINDLTLKGISSFDYEMVKAQEDLQRE
                          MAVGVAFSTNNLARVTCKMDDLSDAESDFLLWNKEAIRRHVKYT
                          EKGEILSAILQFFGGRSLWDESLFEKAYSDSNYELKFLDDLKRAIY
                          AARNETFHFKTAAIDGGSWNTRLFGSLFEKEAGLCLNVEKNKFYS
                          NNLVLFYKQEDLRWLDKLYGKECSRAAQIPSYNTILPRKSFSDFM
                          KQLLGLKEPVYGSAILDQWYSACYYLFKEVYYNLFLQDSSAKALF
                          EKAVKALKGADKKQEKAVESFRKRYWEISKNASLAEICQSYITEY
                          NQQNNKERKVRSANDGMFNEPIYQHYKMLLKEALKMAFASYIKN
                          DKELKFVYKPTEKLFEVSQDNFLPNWNSEKYNTLISEVKNSPDLQ
                          KWYIVGKFMNARMLNLLLGSMRSYLQYVSDIQKRAAGLGENQLH
                          LSAENVGQVKKWIQVLEVCLLLSVRISDKFTDYFKDEEEYASYLK
                          EYVDFEDSAMPSDYSALLAFSNEGKIDLYVDASNPKVNRNIIQAKL
                          YAPDMVLKKVVKKISQDECKEFNEKKEQIMQFKNKGDEVSWEEQ
                          QKILEYQKLKNRVELRDLSEYGELINELLGQLINWSYLRERDLLYF
                          QLGFHYSCLMNESKKPDAYKTIRRGTVSIENAVLYQIIAMYINGFP
                          VYAPEKGELKPQCKTGSAGQKIRAFCQWASMVEKKKYELYNAGL
                          ELFEVVKEHDNIIDLRNKIDHFKYYQGNDSILALYGEIFDRFFTYD
                          MKYRNNVLNHLQNILLRHNVIIKPIISKDKKEVGRGKMKDRAAFL
                          LEEVSSDRFTYKVKEGERKIDAKNRLYLETVRDILYFPNRAVNDK
                          GEDVIICSKKAQDLNEKKADRDKNHDKSKDTNQKKEGKNQEEKS
                          ENKEPYSDRMTWKPFAGIKLE (SEQ ID NO: 77)

C2-21   Blautia sp.       MKISKVDHVKSGIDQKLSSQRGMLYKQPQKKYEGKQLEEHVRNL
        Marseille-        SRKAKALYQVFPVSGNSKMEKELQIINSFIKNILLRLDSGKTSEEIV
        P2398             GYINTYSVASQISGDHIQELVDQHLKESLRKYTCVGDKRIYVPDII
                          ALLKSKFNSETLQYDNSELKILIDFIREDYLKEKQIKQIVHSIENNST
                          PLRIAEINGQKRLIPANVDNPKKSYIFEFLKEYAQSDPKGQESLLQH
                          MRYLILLYLYGPDKITDDYCEEIEAWNFGSIVMDNEQLFSEEASML
```

-continued

```
              IQDRIYVNQQIEEGRQSKDTAKVKKNKSKYRMLGDKIEHSINESVV
              KHYQEACKAVEEKDIPWIKYISDHVMSVYSSKNRVDLDKLSLPYL
              AKNTWNTWISFIAMKYVDMGKGVYHFAMSDVDKVGKQDNLIIG
              QIDPKFSDGISSFDYERIKAEDDLHRSMSGYIAFAVNNFARAICSDE
              FRKKNRKEDVLTVGLDEIPLYDNVKRKLLQYFGGASNWDDSIIDII
              DDKDLVACIKENLYYARNVNFHFAGSEKVQKKQDDILEEIVRKET
              RDIGKHYRKVFYSNNVAVFYCDEDIIKLMNHLYQREKPYQAQIPS
              YNKVISKTYLPDLIFMLLKGKNRTKISDPSIMNMFRGTFYFLLKEIY
              YNDFLQASNLKEMFCEGLKNNVKNKKSEKPYQNFMRRFEELENM
              GMDFGEICQQIMTDYEQQNKQKKKTATAVMSEKDKKIRTLDNDT
              QKYKHFRTLLYIGLREAFIIYLKDEKNKEWYEFLREPVKREQPEEK
              EFVNKWKLNQYSDCSELILKDSLAAAWYVAHFINQAQLNHLIGD
              IKNYIQFISDIDRRAKSTGNPVSESTEIQIERYRKILRVLEFAKFFCGQ
              ITNVLTDYYQDENDFSTHVGHYVKFEKKNMEPAHALQAFSNSLY
              ACGKEKKKAGFYYDGMNPIVNRNITLASMYGNKKLLENAMNPVT
              EQDIRKYYSLMAELDSVLKNGAVCKSEDEQKNLRHFQNLKNRIEL
              VDVLTLSELVNDLVAQLIGWVY1RERDMMYLQLGLHYIKLYFTDS
              VAEDSYLRTLDLEEGSIADGAVLYQIASLYSFNLPMYVKPNKSSVY
              CKKHVNSVATKFDIFEKEYCNGDETVIENGLRLFENINLHKDMVK
              FRDYLAHFKYFAKLDESILELYSKAYDFFFSYNIKLKKSVSYVLTN
              VLLSYFINAKLSFSTYKSSGNKWQHRTTKISVVAQTDYFTYKLRSI
              VKNKNGVESIENDDRRCEVVNIAARDKEFVDEVCNVINYNSDK
              (SEQ ID NO: 78)

C2-22  Leptotrichia   MGNLFGHKRWYEVRDKXDFKIKRKVKVKRNYDGNKYILNINENN
       sp. oral       NKEKIDNNKFIGEFVNYKKNNNVLKEFKRKFHAGNILFKLKGKEEI
       taxon 879      IRIENNDDFLETEEVVLYIEVYGKSEKLKALEITKKKIIDEAIRQGIT
       str. F0557     KDDKKIEIKRQENEEEIEIDIRDEYTNKTLNDCSIILRIIENDELETKK
                      SIYEIFKNINMSLYKIIEKIIENETEKVFENRYYEEHLREKLLKDNKI
                      DVILTNFMEIREKIKSNLEIMGFVKFYLNVSGDKKKSENKKMFVEK
                      ILNTNVDLTVEDIVDFIVKELKFWNITKRIEKVKKFNNEFLENRRNR
                      TYIKSYVLLDKHEKFKIERENKKDKIVKFFVENIKNNSIKEKIEKILA
                      EFKINELIKKLEKELKKGNCDTEIFGIFKKHYKVNFDSKKFSNKSDE
                      EKELYKIIYRYLKGRIEKILVNEQKVRLKKMEKIEIEKILNESILSEKI
                      LKRVKQYTLEHIMYLGKLRHNDIVKMTVNTDDFSRLHAKEELDLE
                      LITFFASTNMELNKIFNGKEKVTDFFGFNLNGQKITLKEKVPSFKLN
                      ILKKLNFINNENNIDEKLSHFYSFQKEGYLLRNKILHNSYGNIQETK
                      NLKGEYENVEKLIKELKVSDEEISKSLSLDVIFEGKVDIINKINSLKI
                      GEYKDKKYLPSFSKIVLEITRKFREINKDKLFDIESEKIILNAVKYVN
                      KILYEKITSNEENEFLKTLPDKLVKKSNNKKENKNLLSIEEYYKNA
                      QVSSSKGDKKAIKKYQNKVTNAYLEYLENTFTEIIDFSKFNLNYDE
                      IKTKIEERXDNKSKIIIDSISTNINITNDIEYIISIFALLNSNTYINKIRNR
                      FFATSVWLEKQNGTKEYDYENIISILDEVLLINLLRENNITDILDLK
                      NAIIDAKIVENDETYIKNYIFESNEEKLKKRLFCEELVDKEDIRKIFE
                      DENFKFKSFIKKNEIGNPKFVFGILSNLECNSEVEAKKIIGKNSKKLE
                      SFIQNIIDEYKSNIRTLFSSEFLEKYKEEIDNLVEDTESENKNKFEKIY
                      YPKEHKNELYIYKKNLFLNIGNPNFDKIYGLISKDIKNVDTKILFDD
                      DIKKNKISEIDAILKNLNDKLNGYSNDYKAKYVNKLKENDDFFAK
                      NIQNENYSSFGEFEKDYNKVSEYKKIRDLVEFNYLNKIESYLIDINW
                      KLAIQMARFERDMHYIVNGLRELGIIKLSGYNTGISRAYPKRNGSD
                      GFYTTTAYYKFFDEESYKKFEKICYGFGIDLSENSEINKPENESIRN
                      YISHFYIVRNPFADYSIAEQIDRVSNLLSYSTRYNNSTYASVFEVFK
                      KDVNLDYDELKKKFRLIGNNDILERLMKPKKVSVLELESYNSDYI
                      KNLIIELLTKIENTNDTL (SEQ ID NO: 79)

C2-23  Lachnospiraceae  MKISKVDHTRMAVAKGNQHRRDEISGILYKDPTKTGSIDFDERFK
       bacterium        KLNCSAKILYHVFNGIAEGSNKYKNIVDKVNNNLDRVLFTGKSYD
       NK4A144          RKSIIDIDTVLRNVEKINAFDRISTEEREQIIDDLLEIQLRKGLRKGK
                        AGLREVLLIGAGVIVRTDKKQEIADFLEILDEDFNKTNQAKNIKLSI
                        ENQGLWSPVSRGEERIFDVSGAQKGKSSKKAQEKEALSAFLLDY
                        ADLDKNVRFEYLRKIRRLINLYFYVKNDDVMSLTEIPAEVNLEKDF
                        DIWRDHEQRKEENGDFVGCPDILLADRDVKKSNSKQVKIAERQLR
                        ESIREKNIKRYRFSIKTIEKDDGTYFFANKQISVFWIHRIENAVERIL
                        GSINDKKLYRLRLGYLGEKVWKDILNFLSIKYIAVGKAVFNFAMD
                        DLQEKDRDIEPGKISENAVNGLTSFDYEQIKADEMLQREVAVNVA
                        FAANNLARVTVDIPQNGEKEDILLWNKSDIKKYKKNSKKGILKSIL
                        QFFGGASTWTNMKMFEIAYHDQPGDYEENYLYDIIQIIYSLRNKSFH
                        FKTYDHGDKNWNRELIGKMIEHDAERVISVEREKFHSNNLPMFYK
                        DADLKKILDLLYSDYAGRASQVPAFNTVLVRKNFPEFLRKI)MGY
                        KVHFNNPEVENQWHSAVYYLKEIYYNLFLRDKEVKNLFYTSLK
                        NIRSEVSDKKQKLASDDFASRCEEIEDRSLPEICQIIMTEYNAQNFG
                        NRKWSQRVTEKNKDIFRHYKMLLIKTLAGAFSLYLKQERFAFIGK
                        ATPIPYETTDVKNFLPEWKSGMYASFVEEIKNNLDLQEWYIVGRFL
                        NGRMLNQLAGSLRSYIQYAEDIEREAAENRNKLFSKPDEKIEACK
                        KAVRVLDLCIKISTRISAEFTDYFDSEDDYADYLEKYLKYQDDAIK
                        ELSGSSYAALDHFCNKDLDKFDIYVNAGQKPILQRNIVMAKLFGP
                        DNILSEVMEKVTESAIREYYDYLKKVSGYRVRGKCSTEKEQEDLL
                        KFQRLKNAVEFRDVTEYAEVINELLGQLISWSYLRERDLLYFQLGF
                        HFYMCLKNKSFKPAEYVDIRRNNGTIIFINAILYQIVSNIYINGLDFYS
                        CDKEGKTLKPIETGKGVGSKIGQFIKYSQYLYNDPSYKLEIYNAGL
                        EVFENIDEHDNITDLRKYVDHFKYYAYGNKMSLLDLYSEFFDRFF
```

-continued

```
              TYDMKYQKNVVNVLENILLRHFVIFYPKFGSGKKDVGIRDCKKER
              AQIEISEQSLTSEDFMFKLDDKAGEEAKKFPARDERYLQTIAKLLY
              YPNEIEDNINRFMKKGETINKKVQFNRKKKITRKQKNNSSNEVLSS
              TMGYLFKNIKL (SEQ ID NO: 80)

C2-24  Chloroflexus   MTDQVRREEVAAGELADTPLAAAQTPAADAAVAATPAPAEAVAP
       aggregans      TPEQAVDQPATTGESEAPVTTAQAAAHEAEPAEATGASFTPVSEQ
                      QPQKPRRLKDLQPGMELEGKVTSIALYGIFVDVGVGRDGLVHISE
                      MSDRRIDTPSELVQIGDTVKVWVKSVDLDARRISLTMLNPSRGEKP
                      RRSRQSQPAQPQPRRQEVDREKLASLKVGEIVEGVITGFAPFGAFA
                      DIGVGKDGLIHISELSEGRVEKPEDAVKVGERYQFKVLEIDGEGTRI
                      SLSLRRAQRTQRMQQLEPGQIIEGTVSGIATFGAFVDIGVGRDGLV
                      HISALAPHRVAKVEDVVKVGDKVKVKVLGVDPQSKRISLTMRLEE
                      EQPATTAGDEAAEPAEEVTPTRRGNLERFAAAAQTARERSERGER
                      SERGERRERRERRPAQSSPDTYIVGEDDDESFEGNATIEDLLTKFGG
                      SSSRRDRDRRRRHEDDDDEEMERPSNRRQREAIRRTLQQIGYDE
                      (SEQ ID NO: 81)

C2-25  Demequina      MDLTWHALLILFWALLAGFLDTLAGGGLLTVPALLLTGIPPLQA
       aurantiaca     LGTNKLQSSFGTGMATYQVIRKKRVHWRDVRWPMVWAFLGSAA
                      GAVAVQFIDTDALLIIPVVLALVAAYFLFVPKSHLPPPEPRMSDPA
                      YEATLVPIIGAYDGAFGPGTGSLYALSGVALRAKTLVQSTALAKTL
                      NFATNFAALIATAFAGHMLWTVGAVMIAGQLIGAYAGSHMLFRV
                      NPLVLRVLIVVMSLGMLIRVLLD (SEQ ID NO: 82)

C2-26  Thalassospira  MRIIKPYGRSHVEGVATQEPRRKLRLNSSPDISRDIPGFAQSHDALII
       sp. TSL5-1     AQWISAIDKIATKPKPDKKPTQAQINLRTTLGDAAWQHVMAENLL
                      PAATDPAIREKLHLTWQSKIAPWGTARPQAEKDGKPTPKGGWYER
                      FCGVLSPEAITQNVARQIAKDIYDHLHVAAKRKGREPAKQGESSN
                      KPGKFKPDRKRGLIEERAESIAKNALRPGSHAPCPWGPDDQATYE
                      QAGDVAGQLYAAARDCLEEKKRRSGNRNTSSVQYLPRDLAAKILY
                      AQYGRVFGPDTTIKAALDEQPSLFALHKAIKDCYHRLINDARKRDI
                      LRILPRNMAALFRLVRAQYDNRDINALIRLGKVIHYHASEQGKSEH
                      HGTRDYWPSQQDIQNSRFWGSDGQADIKRHEAFSRIWRHIIALASR
                      TLHDWADPHSQKFSGENDDILLLAKDAIEDDVFKAGHYERKCDVL
                      FGAQASLFCGAEDFEKAILKQAITGTGNLRNATFHFKGKVRFEKEL
                      QELTKDVPVEVQSAIAALWQKDAEGRTRQIAETLQAVLAGHFLTE
                      EQNRHIFAALTAAMAPGDVPLPRLRRVLARHDSICQRGRILPLSP
                      CPDRAKLEESPALTCQYTVLKMLYDGPPFRAWLAQQNSTILNHYID
                      STIARTDKAARDMNGRKLAQAEKDLITSRAADLPRLSVDEKMGDF
                      LARLTAATATEMRVQRGYQSDGENAQKQAAFIGQFECDVIGRAF
                      ADFLNQSGFDFVLKLKADTPQPDAAQCDVTALIAPDDISVSPPQA
                      WQQVLYFILHLVPVDDASHLLHQIRKWQVLEGKEKPAQIAHDVQS
                      VLMLYLDMHDAKFTGGAALHGIEKFAEFFAHAADFRAVFPPQSLQ
                      DQDRSIPRRGLREIVRFGHLPLLQHMSGTVQITHDNVVAWQAART
                      AGATGMSPIARRQKQREELHALAVERTARFRNADLQNYMHALVD
                      VIKHRQLSAQVTLSDQVRLHRLMMGVLGRLVDYAGLWERDLYF
                      VVLALLYHHGATPDDVFKGQGKKNLADGQVVAALKPKNRKAAA
                      PVGVFDDLDHYGIYQDDRQSIRNGLSHFNMLRGGKAPDLSHWVN
                      QTRSLVAHDRKLKNAVAKSVIEMLAREGFDLDWGIQTDRGQHILS
                      HGKIRTRQAQHFQKSRLHIVKKSAKPDKNDTVKIRENLHGDAMVE
                      RVVQLFAAQVQKRYDRTVEKRLDHLFLKPQDQKGKNGIHTHNGW
                      SKTEKKRRPSRENRKGNHEN (SEQ ID NO: 83)

C2-27  SAMN04487830_13920  MKFSKESHRKTAVGVTESNGIIGLLYKDPLNEKEKIEDVVNQRANS
       [pseudobutyrivibrio  TKRLFNLFGTEATSKDISRASKDLAKVVNKAIGNLKGNKKFNKKE
       sp.                  QITKGLNTKIIVEELKNVLKDEKKLIVNKDIIDEACSRLLKTSFRTA
       OR37]                KTKQAVKMILTAVLIENTNLSKEDEAFVHEYFVKKLVNEYNKTSV
                            KKQIPVALSNQNMVIQPNSVNGTLEISETKKSKETKTTEKDAFRAF
                            LRDYATLDENRRHKMRLCLRNLVNLYFYGETSVSKDDFDEWRDH
                            EDKKQNDELFVKKIVSIKTDRKGNVKEVLDVDATIDAIRTNNIACY
                            RRALAYANENPDVFFSDTMLNKFWIHHVENEVERIYGHINNNTGD
                            YKYQLGYLSEKVWKGIINYLSIKYIAEGKAVYNYAMNALAKDNN
                            SNAFGKLDEKFVNGITSFEYERIKAEETLQRECAVNTAFAANHLAN
                            ATVDLNEKDSDFLLLKHEDNKDTLGAVARPNILRNILQFFGGKSR
                            WNDFDFSGIDEIQLLDDLLRKMIYSLRNSSFHFKTENIDNDSWNTKLI
                            GDMFAYDFNMAGNVQKDKMYSNNVPMFYSTSDIEKMLDRLYAE
                            VHERASQVPSFNSVFVRKNFPDYLKNDLKITSAFGVDDALKWQSA
                            VYYVCKEIYYNDFLQNPETFTMLKDYVQCLPIDIDKSMDQKLKSE
                            RNAHKNFKEAFATYCKECDSLSAICQMIMTEYNNQNKGNRKVISA
                            RTKDGDKLIYKHYKMILFEALKNVFTITLEKNINTYGFLKKPKLIN
                            NVPAIEEFLPNYNGRQYETLVNRTTEETELQKWYIVGRLLNPKQVN
                            QLIGNFRSYVQYVNDVARRAKQTGNNLSNDNIAWDVKNIIQIFDV
                            CTKLNGVTSNILEDYFDDGDDYARYLKNFVDYTNKNNDHSATLL
                            GDFCAKEIDGIKIGIYHDGTNPIVNRNIIQCKLYGATGIISDLTKDGSI
                            LSVDYEIIKKYMQMQKEIKVYQQKGICKTKEEQQNLKKYQELKNI
                            VELRNIIDYSEILDELQGQLINWGYLRERDLMYFQLGFHYLCLHNE
                            SKKPVGYNNAGDISGAVLYQIVAMYTNGLSLIDANGKSKKNAKA
                            SAGAKVGSFCSYSKEIRGVDKDTKEDDDPIYLAGVELFENINEHQQ
                            CINLRNYIEHFHYYAKHDRSMLDLYSEVFDRFFTYDMKYTKNVPN
                            MMYNTLLQHLVVPAFEFGSSEKRLDDNDEQTKPRAMFTLREKNGL
```

-continued

SSEQFTYRLGDGNSTVKLSARGDDYLRAVASLLYYPDRAPEGLIR
DAEAEDKFAKINHSNPKSDNRNNRGNFKNPKVQWYNNKTKRK
(SEQ ID NO: 84)

C2-28 SAMN02910398_00008
[*Butyrivibrio*
sp.
YAB3001]

MKISKVDHRKTAVKITDNKGAEGFIYQDPTRDSSTMEQIISNRARS
SKVLFNIFGDTKKSKDLNKYTESLIIYVNKAIKSLKGDKRNNKYEEI
TESLKTERVLNALIQAGNEFTCSENNIEDALNKYLKKSFRVGNTKS
ALKKLLMAAYCGYKLSIEEKEEIQNYFVDKLVKEYNKDTVLKYT
AKSLKHQNMVVQPDTDNHVFLPSRIAGATQNKMSEKEALTEFLK
AYAVLDEEKRHNLRIILRKLVNLYFYESPDFIYPENNEWKEFIDDRK
NKTETFVSPVKVNEEKNGKTFVKIDVPATKDLTRLKNIECYRRSVA
ETAGNPITYFTDFHNISKFWIHHIENEVEKIFALLKSNWKDYQFSVG
YISEKVWKEIINYLSIKYIAIGKAVYNYALEDIKKNDGTLNFGVIDP
SFYDGINSFEYEKIKAEETFQREVAWVSFAVNHLSSATVKLSEAQ
SDMLVLNKNDIEKIAYGNTKRNILQFFGGQSKWKEFDFDRYINPV
NYTDIDFLFDIKKMVYSLRNESFHFTTTDTESDWNKNLISAMFEYE
CRRISTVQKNKFFSNNLPLFYGENSLERVLHKLYDDYVDRMSQVP
SFGNVFVRKKFPDYMKEIGIKHNLSSEDNLKLQGALYFLYKEIYYN
AFISSEKAMKIFVDLVNKLDTNARDDKGRITHEAMAHKNFKDAIS
HYMTHDCSLADICQKIMTEYNQQNTGHRKKQTTYSSEKNPEIFRH
YKMILFMLLQKAMTEYISSEEIFDFIMKPNSPKTDIKEEEFLPQYKS
CAYDNLIKLIADNVELQKWYITARLLSPREVNQLIGSFRSYKQFVS
DIERRAKETNNSLSKSGMTVDVENITKVLDLCTKLNGRFSNELTDY
FDSKDDYAVYVSKFLDFGFKIDEKFPAALLGEFCNKEEENGKKIGIY
HNGTEPILNSNIIKSKLYGITDVVSRAVKPVSEKLIREYLQQEVKIKP
YLENGVCKNKEEQAALRKYQELKNRIEFRDIVEYSEIINELMGQLI
NFSYLREDLMYFQLGFHYLCLNNYGAKPEGYYSIVNDKRTIKGA
ILYQIVAMYTYGLPIYHYVDGTISDRRKNKKTVLDTLNSSETVGAK
IKYFIYYSDELFNDSLILYNAGLELFENINEHENIVNLRKYIDHFKY
YVSQDRSLLDIYSEVFDRYFTYDRKYKNVMNLFSNIMLKHFIITD
FEFSTGEKTIGEKNTAKKECAKVRIKRGGLSSDKFTYKFKDAKPIE
LSAKNTEFLDGVARILYYPENVVLTDLVRNSEVEDEKRIEKYDRN
HNSSPTRKDKTYKQDVKKNYNKKTSKAFDSSKLDTKSVGNNLSD
NPVLKQFLSESKKKR (SEQ ID NO: 85)

C2-29 *Blautia* sp.
Marseille-
P2398

MKISKVDHVKSGIDQKLSSQRGMLYKQPQKKYEGKQLEEHVRNL
SRKAKALYQVFPVSGNSKMEKELQIINSFIKNILLRLDSGKTSEEIV
GYINTYSVASQISGDHIQELVDQHLKESLRKYTCVGDKRIYVPDIIV
ALLKSKFNSETLQYDNSELKILIDFIREDYLKEKQIKQIVHSIENNST
PLRIAEINGQKRLIPANVDNPKKSYIFEFLKEYAQSDPKGQESLLQH
MRYLILLYLYGPDKITDDYCEEIEAWNFGSIVMDNEQLFSEEASML
IQDRIYVNQQIEEGRQSKDTAKVKKNKSKYRMLGDKIEHSINESVV
KHYQEACKAVEEKDIPWIKYISDHVMSVYSSKNRVDLDKLSLPYL
AKNTWNTWISFIAMKYVDMGKGVYHFAMSDVDKVGKQDNLIIG
QIDPKFSDGISSFDYERIKAEDDLHRSMSGYIAFAVNNFARAICSDE
FRKKNRKEDVLTVGLDEIPLYDNVKRKLLQYFGGASNWDDSIIDII
DDKDLVACIKENLYVARNVNFHFAGSEKVQKKQDDILEEIVRKET
RDIGKHYRKVFYSNNVAVFYCDEDIIKLMNHLYQREKPYQAQIPS
YNKVISKTYLPDLIFMLLKGKNRTKISDPSIMNMFRGTFYFLLKEIY
YNDFLQASNLKEMFCEGLKNNVKNKKSEKPYQNFMRRFEELENM
GMDFGEICQQIMTDYEQQNKQKKKTATAVMSEKDKKIRTLDNDT
QKYKHFRTLLYIGLREAFIIYLKDEKNKEWYEFLREPVKREQPEEK
EFVNKWKLNQYSDCSELILKDSLAAAWYVVAHFINQAQLNHLIGD
IKNYIQFISDIDRRAKSTGNPVSESTEIQIERYRKILRVLEFAKFFCGQ
ITNVLTDYYQDENDFSTHVGHYVKFEKKNMEPAHALQAFSNSLY
ACGKEKKKAGFYYDGMNPIVNRNITLASMYGNKKLLENAMNPVT
EQDIRKYYSLMAELDSVLKNGAVCKSEDEQKNLRHFQNLKNRIEL
VDVLTLSELVNDLVAQLIGWVYIRERDMMYLQLGLHYIKLYFTDS
VAEDSYLRTLDLEEGSIADGAVLYQIASLYSFNLPMYVKPNKSSVY
CKKHVNSVATKFDIFEKEYCNGDETVIENGLRLFENINLHKDMVK
FRDYLAHFKYFAKLDESILELYSKAYDFFFSYNIKLKKSVSYVLTN
VLLSYFINAKLSFSTYKSSGNKTVQHRTTKISVVAQTDYFTYKLRSI
VKNKNGVESIENDDRRCEVVNIAARDKEFVDEVCNVINYNSDK
(SEQ ID NO: 86)

C2-30 *Leptotrichia*
sp.
Marseille-
P3007

MKITKIDGISHKKYIKEGKLVKSTSEENKTDERLSELLTIRLDTYIK
NPDNASEEENRIRRENLKEFFSNKVLYLKDGILYLKDRREKNQLQN
KNYSEEDISEYDLKNKNNFLVLKKILLNEDINSEELEIFRNDFEKKL
DKINSLKYSLEENKANYQKINENNIKKVEGKSKRNIFYNYYKDSA
KRNDYINNIQEAFDKLYKKEDIENLFFLIENSKKHEKYKIRECYHKI
IGRKNKDKENFATIIYEEIQNVNNMKELIEKVPNVSELKKSQVFYKY
YLNKEKLNDENIKYVFCHPVEIEMSKLLKNYVYKKPSNISNDKVK
RIFEYQSLKKLIENKLLNKLDTYVRNCGKYSFYLQDGEIATSDPIVG
NRQNEAFLRNIIGVSSTAYFSLRNILETENENDITGRMRGKTVKNN
KGEEKYISGEIDKLYDNNKQNEVKKNLKMFYSYDFNMMSKKEIED
FFSNIDEAISSIRHGIVHFNLELEGKDIFTFKNIVPSQISKKMFHDEIN
EKKLKLKIFKQLNSANVFRYLEKYKILNYLNRTRFEFVNKNIPFVPS
FTKLYSRIDDLKNSLGIYWKTPKTNDDNKTKEITDAQIYLLKNIYY
GEFLNYFMSNNGNFFEITKEIIELNKNDKRNLKTGFYKLQKFENLQ
EKTPKEYLANIQSLYMINAGNQDEEEKDTYIDFIQKIFLKGFMTYL

-continued

```
                    ANNGRLSLIYIGSDEETNTSLAEKKQEFDKFLKKYEQNNNIEIPYEI
                    NEFVREIKLGKILKYTERLNMFYLILKLLNHKELTNLKGSLEKYQS
                    ANKEEAFSDQLELINLLNLDNNRVTEDFELEADEIGKFLDFNGNKV
                    KDNKELKKFDTNKIYFDGENIIKHRAFYNIKKYGMLNLLEKISDEA
                    KYKISIEELKNYSKKKNEIEENHTTQENLHRKYARPRKDEKFTDED
                    YKKYEKAIRNIQQYTHLKNKVEFNELNLLQSLLLRILHRLVGYTSI
                    WERDLRFRLKGEFPENQYIEEIFNFDSKNVKYKNGQIVEKYINFY
                    KELYKDDTEKISIYSDKKVKELKKEKKDLYIRNYIAHFNYIPNAEIS
                    LLEMLENLRKLLSYDRKLKNAIMKSIVDILKEYGFVVTFKIEKDKK
                    IRIESLKSEEVVHLKKLKLKDNDKKKEPIKTYRNSKELCKLVKVMF
                    EYKMKEKKSEN (SEQ ID NO: 87)
```

C2-31  *Bacteroidesihuae*
```
                    MRITKVKVKESSDQKDKMVLIHRKVGEGTLVLDENLADLTAPIID
                    KYKDKSFELSLLKQTLVSEKEMNIPKCDKCTAKERCLSCKQREKR
                    LKEVRGAIEKTIGAVIAGRDIIPRLNIFNEDEICWLIKPKLRNEFTFK
                    DVNKQVVKLNLPKVLVEYSKKNDPTLFLAYQQWIAAYLKNKKG
                    HIKKSILNNRVVIDYSDESKLSRKQALELWGEEYETNQRIALESY
                    HTSYNIGELVTLLPNPEEYVSDKGEIRPAFHYKLKNVLQMHQSTVF
                    GTNEILCINPIFNENRANIQLSAYNLEVVKYFEHYFPIKKKKKNLSL
                    NQAIYYLKVETLKERLSLQLENALRMNLLQKGKIKKHEFDKNTCS
                    NTLSQIKRDEFFVLNLVEMCAFAANNIRNIVDKEQVNEILSKKDLC
                    NSLSKNTIDKELCTKFYGADFSQIPVAIWAMRGSVQQIRNEIVHYK
                    AEAIDKIFALKTFEYDDMEKDYSDTPFKQYLELSIEKIDSFFIEQLSS
                    NDVLNYYCTEDVNKLLNKCKLSRRTSIPFAPGFKTIYELGCHLQD
                    SSNTYRIGHYLMLIGGRVANSTVTKASKAYPAYRFMLKLIYNHLF
                    LNKFLDNHNKRFFMKAVAFVLKDNRENARNKFQYAFKEIRMMN
                    NDESIASYMSYIHSLSVQEQEKKGDKNDKVRYNTEKFIEKVFVKG
                    FDDDFLSWLGVEFILSPNQEERDKTVTREEYENLMIKDRVEHSINSN
                    QESHIAFFTFCKLLDANHLSDLRNEWIKFRSSGDKEGFSYNFAIDIIE
                    LCLLTVDRVEQRRDGYKEQTELKEYLSFFIKGNESENTVWKGFYF
                    QQDNYTPVLYSPIELIRKYGTLELLKLIIVDEDKITQGEFEEWQTLK
                    KVVEDKVTRRNELHQEWEDMKNKSSFSQEKCSIYQKLCRDIDRY
                    NWLDNKLHLVHLRKLHNLVIQILSRMARFIALWDRDFVLLDASRA
                    NDDYKLLSFFNFRDFINAKKTKTDDELLAEFGSKIEKKNAPFIKAE
                    DVPLMVECIEAKRSFYQKVFFRNNLQVLADRNFIAHYNYISKTAK
                    CSLFEMIIKLRTLMYYDRKLRNAVVKSIANVFDQNGMVLQLSLDD
                    SHELKVDKVISKRIVHLKNNNIMTDQVPEEYYKICRRLLEMKK
                    (SEQ ID NO: 88)
```

C2-32  SAMN05216357_1045
       [Porphyromonadaceae
       bacterium
       KH3CP3RA]
```
                    MEFRDSIFKSLLQKEIEKAPLCFAEKLISGGVFSYYPSERLKEFVGN
                    HPFSLFRKTMPFSPGFKRVMKSGGNYQNANRDGRFYDLDIGVYLP
                    KDGFGDEEWNARYFLMKLIYNQLFLPYFADAENHLFRECVDFVK
                    RVNRDYNCKNNNSEEQAFIDIRSMREDESIADYLAFIQSNIIIEENK
                    KKETNKEGQINFNKFLLQVFVKGFDSFLKDRTELNLQLPELQGDG
                    TRGDDLESLDKLGAVVAVDLKLDATGIDADLNENISFYTFCKLLD
                    SNHLSRLRNEIIKYQSANSDFSHNEDFDYDRIISIIELCMLSADHVST
                    NDNESIFPNNDKDFSGIRPYLSTDAKVETFEDLYVHSDAKTPITNAT
                    MVLNWKYGTDKLFERLMISDQDFLVTEKDYFVWKELKKDIEEKI
                    KLREELHSLWVNTPKGKKGAKKKNGRETTGEFSEENKKEYLEVC
                    REIDRYVNLDNKLHFVHLKRMHSLLIELLGRFVGFTYLFERDYQY
                    YHLEIRSRRNKDAGVVDKLEYNKIKDQNKYDKDDFFACTFLYEK
                    ANKVRNFIAHFNYLTMWNSPQEEEHNSNLSGAKNSSGRQNLKCSL
                    TELINELREVMSYDRKLKNAVTKAVIDLFDKHGMVIKFRIVNNNN
                    NDNKNKHHLELDDIVPKKIMHLRGIKLKRQDGKPIPIQTDSVDPLY
                    CRMWKKLLDLKPTPF (SEQ ID NO: 89)
```

C2-33  *Listeria*
       *riparia*
```
                    MHDAWAENPKKPQSDAFLKEYKACCEAIDTYNWHKNKATLVYV
                    NELHHLLIDILGRLVGYVAIADRDFQCMANQYLKSSGHTERVDSW
                    INTIRKNRPDYIEKLDIFMNKAGLFVSEKNGRNYIAHLNYLSPKHK
                    YSLLYLFEKLREMLKYDRKLKNAVTKSLIDLLDKHGMCVVFANL
                    KNNKHRLVIASLKPKKIETFKWKKIK (SEQ ID NO: 90)
```

C2-34  *Insolitispirillum*
       *peregrinum*
```
                    MRIIRPYGSSTVASPSPQDAQPLRSLQRQNGTFDVAEFSRRHPELVL
                    AQWVAMLDKIIRKPAPGKNSTALPRPTAEQRRLRQQVGAALWAE
                    MQRHTPVPPELKAVWDSKVHPYSKDNAPATAKTPSHRGRWYDRF
                    GDPETSAATVAEGVRRHLLDSAQPFRANGGQPKGKGVIEHRALTI
                    QNGTLLHHHQSEKAGPLPEDWSTYRADELVSTIGKDARWIKVAAS
                    LYQHYGRIFGPTTPISEAQTRPEFVLHTAVKAYYRRLFKERKLPAE
                    RLERLLPRTGEALRHAVTVQHGNRSLADAVRIGKILHYGWLQNGE
                    PDPWPDDAALYSSRYWGSDGQTDIKHSEAVSRVWRRALTAAQRT
                    LTSWLYPAGTDAGDILLIGQKPDSIDRNRLPLLYGDSTRHWTRSPG
                    DVWLFLKQTLENLRNSSFHFKTLSAFTSHLDGTCESEPAEQQAAQ
                    ALWQDDRQQDHQQVFLSLRALDATTYLPTGPLHRIVNAVQSTDA
                    TLPLPRFRRVVTRAANTRLKGFPVEPVNRRTMEDDPLLRCRYGVL
                    KLLYERGFRAWLETRPSIASCLDQSLKRSTKAAQTINGKNSPQGVE
                    ILSRATKLLQAEGGGGHGIHDLFDRLYAATAREMRVQVGYHHDA
                    EAARQQAEFIEDLKCEVVARAFCAYLKTLGIQGDTFRRQPEPLPTW
                    PDLPDPSSTIGTAQAALYSVLHLMPVEDVGSLLHQLRRWLVALQ
                    ARGGEDGTAITATIPLLELYLNRHDAKFSGGGAGTGLRWDDWQV
                    FFDCQATFDRVFPPGPALDSHRLPLRGLREVLRFGRVNDLAALIGQ
                    DKITAAEVDRWHTAEQTIAAQQQRREALHEQLSRKKGTDAEVDE
```

```
                                        -continued
                    YRALVTAIADHRHLTAHVTLSNVVRLHRLMTTVLGRLVDYGGLW
                    ERDLTFVTLYEAHRLGGLRNLLSESRVNKFLDGQTPAALSKKNNA
                    EENGMISKVLGDKARRQIRNDFAHFNMLQQGKKTINLTDEINNAR
                    KLMAHDRKLKNAITRSVTTLLQQDGLDIVWTMDASHRLTDAKIDS
                    RNAIHLHKTHNRANIREPLHGKSYCRWVAALFGATSTPSATKKSD
                    KIR (SEQ ID NO: 91)
```

Example 27: Identification of C2c2 Orthologs

Certain Cas13b orthologs are surprisingly similar to C2c2. FIG. 54 provides a tree alignment of C2c2 and Cas13b proteins. The following Cas13b proteins may be codon optimized for expression in mammalian cells.

```
Bergeyella             1    MENKTSLGNNIYYNPFKPQDKSYFAGYFNAAMENTDSVFRELGKRLK
zoohelcum                   GKEYTSENFFDAIFKENISLVEYERYVKLLSDYFPMARLLDKKEVPIKE
                            RKENFKKNFKGIIKAVRDLRNFYTHKEHGEVEITDEIFGVLDEMLKST
                            VLTVKKKKVKTDKTKEILKKSIEKQLDILCQKKLEYLRDTARKIEEKR
                            RNQRERGEKELVAPFKYSDKRDDLIAAIYNDAFDVYIDKKKDSLKESS
                            KAKYNTKSDPQQEEGDLKIPISKNGVVFLLSLFLTKQEIHAFKSKIAGF
                            KATVIDEATVSEATVSHGKNSICFMATHEIFSHLAYKKLKRKVRTAEI
                            NYGEAENAEQLSVYAKETLMMQMLDELSKVPDVVYQNLSEDVQKT
                            FIEDWNEYLKENNGDVGTMEEEQVIHPVIRKRYEDKFNYFAIRFLDEF
                            AQFPTLRFQVHLGNYLHDSRPKENLISDRRIKEKITVFGRLSELEHKKA
                            LFIKNTETNEDREHYWEIFPNPNYDFPKENISVNDKDFPIAGSILDREK
                            QPVAGKIGIKVKLLNQQYVSEVDKAVKAHQLKQRKASKRSIQNIIEEI
                            VPINESNPKEAIVFGGQPTAYLSMNDIHSILYEFFDKWEKKKEKLEKK
                            GEKELRKEIGKELEKKIVGKIQAQIQQIIDKDTNAKILKPYQDGNSTAI
                            DKEKLIKDLKQEQNILQKLKDEQTVREKEYNDFIAYQDKNREINKVR
                            DRNHKQYLKDNLKRKYPEAPARKEVLYYREKGKVAVWLANDIKRF
                            MPTDFKNEWKGEQHSLLQKSLAYYEQCKEELKNLLPEKVFQHLPFKL
                            GGYFQQKYLYQFYTCYLDKRLEYISGLVQQAENFKSENKVFKKVENE
                            CFKFLKKQNYTHKELDARVQSILGYPIFLERGFMDEKPTIIKGKTFKGN
                            EALFADWFRYYKEYQNFQTFYDTENYPLVELEKKQADRKRKTKIYQ
                            QKKNDVFTLLMAKHIFKSVFKQDSIDQFSLEDLYQSREERLGNQERAR
                            QTGERNTNYIWNKTVDLKLCDGKITVENVKLKNVGDFIKYEYDQRV
                            QAFLKYEENIEWQAFLIKESKEEENYPYVVEREIEQYEKVRREELLKE
                            VHLIEEYILEKVKDKEILKKGDNQNFKYYILNGLLKQLKNEDVESYKV
                            FNLNTEPEDVNINQLKQEATDLEQKAFVLTYIRNKFAHNQLPKKEFW
                            DYCQEKYGKIEKEKTYAEYFAEVFKKEKEALIK (SEQ ID NO: 92)

Prevotella             2    MEDDKKTTDSIRYELKDKHFWAAFLNLARHNVYITVNHINKILEEGEI
intermedia                  NRDGYETTLKNTWNEIKDINKKDRLSKLIIKHFPFLEAATYRLNPTDTT
                            KQKEEKQAEAQSLESLRKSFFVFIYKLRDLRNHYSHYKHSKSLERPKF
                            EEGLLEKMYNIFNASIRLVKEDYQYNKDINPDEDFKHLDRTEEEFNYY
                            FTKDNEGNITESGLLFFVSLFLEKKDAIWMQQKLRGFKDNRENKKKM
                            TNEVFCRSRMLLPKLRLQSTQTQDWILLDMLNELIRCPKSLYERLREE
                            DREKFRVPIEIADEDYDAEQEPFKNTLVRHQDRFPYFALRYFDYNEIFT
                            NLRFQIDLGTYHFSIYKKQIGDYKESHHLTHKLYGFERIQEFTKQNRPD
                            EWRKFVKTFNSFETSKEPYIPETTPHYHLENQKIGIRFRNDNDKIWPSL
                            KTNSEKNEKSKYKLDKSFQAEAFLSVHELLPMMFYYLLLKTENTDND
                            NEIETKKKENKNDKQEKHKIEEIIENKITEIYALYDTFANGEIKSIDELE
                            EYCKGKDIEIGHLPKQMIAILKDEHKVMATEAERKQEEMLVDVQKSL
                            ESLDNQINEEIENVERKNSSLKSGKIASWLVNDMMRFQPVQKDNEGK
                            PLNNSKANSTEYQLLQRTLAFFGSEHERLAPYFKQTKLIESSNPHPFLK
                            DTEWEKCNNILSFYRSYLEAKKNFLESLKPEDWEKNQYFLKLKEPKT
                            KPKTLVQGWKNGFNLPRGIFTEPIRKWFMKHRENITVAELKRVGLVA
                            KVIPLFFSEEYKDSVQPFYNYHFNVGNINKPDEKNFLNCEERRELLRK
                            KKDEFKKMTDKEKEENPSYLEFKSWNKFERELRLVRNQDIVTWLLC
                            MELFNKKKIKELNVEKIYLKNINTNTTKKEKNTEEKNGEEKNIKEKNN
                            ILNRIMPMRLPIKVYGRENFSKNKKKKIRRNTFFTVYIEEKGTKLLKQG
                            NFKALERDRRLGGLFSFVKTPSKAESKSNTISKLRVEYELGEYQKARIE
                            IIKDMLALEKTLIDKYNSLDTDNFNKMLTDWLELKGEPDKASFQNDV
                            DLLIAVRNAFSHNQYPMRNRIAFANINPFSLSSANTSEEKGLGIANQLK
                            DKTHKTIEKIIEIEKPIETKE (SEQ ID NO: 93)

Prevotella             3    MQKQDKLFVDRKKNAIFAFPKYITIMENKEKPEPIYYELTDKHFWAAF
buccae                      LNLARHNVYTTINHINRRLEIAELKDDGYMMGIKGSWNEQAKKLDK
                            KVRLRDLIMKHFPPFLEAAAYEMTNSKSPNNKEQREKEQSEALSLNNL
                            KNVLFIFLEKLQVLRNYYSHYKYSEESPKPIFETSLLKNMYKVFDANV
                            RLVKRDYMHHENIDMQRDFTHLNRKKQVGRTKNIIDSPNFHYHFAD
                            KEGNMTIAGLLFFVSLFLDKKDAIWMQKKLKGFKDGRNLREQMTNE
                            VFCRSRSISLPKLKLENVQTKDWMQLDMLNELVRCPKSLYERLREKDR
                            ESFKVPFDIFSDDYNAEEEPFKNTLVRHQDRFPYFVLRYFDLNEIFEQL
                            RFQIDLGTYHFSIYNKRIGDEDEVRHLTHHLYGFARIQDFAPQNQPEE
                            WRKLVKDLDHFETSQEPYISKTAPHYHLENEKIGIKFCSAHNNLFPSL
                            QTDKTCNGRSKFNLGTQFTAEAFLSVHELLPMMFYYLLLTKDYSRKE
                            SADKVEGIIRKEISNIYAIYDAFANNEINSIADLTRRLQNTNILQGHLPK
```

|  |  |  |
|---|---|---|
|  |  | QMISILKGRQKDMGKEAERKIGEMIDDTQRRLDLLCKQTNQKIRIGKR<br>NAGLLKSGKIADWLVNDMMRFQPVQKDQNNIPINNSKANSTEYRML<br>QRALALFGSENFRLKAYFNQMNLVGNDNPHPFLAETQWEHQTNILSF<br>YRNYLEARKKYLKGLKPQNWKQYQHFLILKVQKTNRNTLVTGWKN<br>SFNLPRGIFTQPIREWFEKHNNSKRIYDQILSFDRVGFVAKAIPLYFAEE<br>YKDNVQPFYDYPFNIGNRLKPKKRQFLDKKERVELWQKNKELFKNY<br>PSEKKKTDLAYLDFLSWKKFERELRLIKNQDIVTWLMFKELFNMATV<br>EGLKIGEIHLRDIDTNTANEESNNILNRIMPMKLPVKTYETDNKGNILK<br>ERPLATFYIEETETKVLKQGNFKALVKDRRLNGLFSFAETTDLNLEEH<br>PISKLSVDLELIKYQTTRISIFEMTLGLEKKLIDKYSTLPTDSFRNMLER<br>WLQCKANRPELKNYVNSLIAVRNAFSHNQYPMYDATLFAEVKKFTL<br>FPSVDTKKIELNIAPQLLEIVGKAIKEIEKSENKN (SEQ ID NO: 94) |
| *Porphyromonas gingivalis* | 4 | MNTVPASENKGQSRTVEDDPQYFGLYLNLARENLIEVESHVRIKFGK<br>KKLNEESLKQSLLCDHLLSVDRWTKVYGHSRRYLPFLHYFDPDSQIE<br>KDHDSKTGVDPDSAQRLIRELYSLLDFLRNDFSHNRLDGTTFEHLEVS<br>PDISSFITGTYSLACGRAQSRFAVFFKPDDFVLAKNRKEQLISVADGKE<br>CLTVSGFAFFICLFLDREQASGMLSRIRGFKRTDENWARAVHETFCDL<br>CIRHPHDRLESSNTKEALLLDMLNELNRCPRILYDMLPEEERAQFLPA<br>LDENSMNNLSENSLDEESRLLWDGSSDWAEALTKRIRHQDRFPYLML<br>RFIEEMDLLKGIRFRVDLGEIELDSYSKKVGRNGEYDRTITDHALAFG<br>KLSDFQNEEEVSRMISGEASYPVRFSLFAPRYAIYDNKIGYCHTSDPVY<br>PKSKTGEKRALSNPQSMGFISVHDLRKLLLMELLCEGSFSRMQSDFLR<br>KANRILDETAEGKLQFSALFPEMRHRFIPPQNPKSKDRREKAETTLEK<br>YKQEIKGRKDKLNSQLLSAFDMDQRQLPSRLLDEWMNIRPASHSVKL<br>RTYVKQLNEDCRLRLRKFRKDGDGKARAIPLVGEMATFLSQDIVRMII<br>SEETKKLITSAYYNEMQRSLAQYAGEENRRQFRAIVAELRLLDPSSGH<br>PFLSATMETAHRYTEGFYKCYLEKKREWLAKIFYRPEQDENTKRRISV<br>FFVPDGEARKLLPLLIRRRMKEQNDLQDWIRNKQAHPIDLPSHLFDSK<br>VMELLKVDGKKKWNEAFKDWWSTKYPDGMQPFYGLRRELNIHGK<br>SVSYIPSDGKKFADCYTHLMEKTVRDKKRELRTAGKPVPPDLAADIK<br>RSPHRAVNEREFMLRLVQEDDRLMLMAINKMMTDREEDILPGLKNID<br>SILDEENQFSLAVHAKVLEKEGEGGDNSLSLVPATIEIKSKRKDWSKYI<br>RYRYDRRVPGLMSHFPEHKATLDEVKTLLGEYDRCRIKIFDWAFALE<br>GAIMSDRDLKPYLHESSSREGKSGEHSTLVKMLVEKKGCLTPDESQY<br>LILIRNKAAHNQFPCAAEMPLIYRDVSAKVGSIEGSSAKDLPEGSSLVD<br>SLWKKYEMIIRKILPILDPENRFFGKLLNNMSQPINDL (SEQ ID NO: 95) |
| *Bacteroides pyogenes* | 5 | MESIKNSQKSTGKTLQKDPPYFGLYLNMALLNVRKVENHIRKWLGD<br>VALLPEKSGFHSLLTTDNLSSAKWTRFYYKSRKFLPFLEMFDSDKKSY<br>ENRRETAECLDTIDRQKISSLLKEVYGKLQDIRNAFSHYIDDQSVKH<br>TALIISSEMHRFIENAYSFALQKTRARFTGVFYETDFLQAEEKGDNKKF<br>FAIGGNEGIKLKDNALIFLICLFLDREEAFKFLSRATGFKSTKEKGFLA<br>VRETFCALCCRQPHERLLSVNPREALLMDMLNELNRCPDILFEMLDE<br>KDQKSFLPLLGEEEQAHILENSLNDELCEAIDDPFEMIASLSKRVRYKN<br>RFPYLMLRYIEEKNLLPFIRFRIDLGCLELASYPKKMGEENNYERSVTD<br>HAMAFGRLTDFHNEDAVLQQITKGITDEVRFSLYAPRYAIYNNKIGFV<br>RTSGSDKISFPTLKKKGGEGHCVAYTLQNTKSFGFISIYDLRKILLLSFL<br>DKDKAKNIVSGLLEQCEKHWKDLSENLFDAIRTELQKEFPVPLIRYTL<br>PRSKGGKLVSSKLADKQEKYESEFERRKEKLTEILSEKDFDLSQIPRRM<br>IDEWLNVLPTSREKKLKGYVETLKLDCRERLRVFEKREKGEHPLPPRI<br>GEMATDLAKDIIRMVIDQGVKQRITSAYYSEIQRCLAQYAGDDNRRH<br>LDSIIRELRLKDTKNGHPFLGKVLRPGLGHTEKLYQRYFEEKKEWLEA<br>TFYPAASPKRVPRFVNPPTGKQKELPLIIRNLMKERPEWRDWKQRKN<br>SHPIDLPSQLFENEICRLLKDKIGKEPSGKLKWNEMFKLYWDKEFPNG<br>MQRFYRCKRRVEVFDKVVEYEYSEEGGNYKKYYEALIDEVVRQKISS<br>SKEKSKLQVEDLTLSVRRVFKRAINEKEYQLRLLCEDDRLLFMAVRD<br>LYDWKEAQLDLDKIDNMLGEPVSVSQVIQLEGGQPDAVIKAECKLKD<br>VSKLMRYCYDGRVKGLMPYFANHEATQEQVEMELRHYEDHRRRVF<br>NWVFALEKSVLKNEKLRRFYEESQGGCEHRRCIDALRKASLVSEEEY<br>EPLVHIRNKSAHNQFPDLEIGKLPPNVTSGFCECIWSKYKAIICRIIPFID<br>PERRFFGKLLEQK (SEQ ID NO: 96) |
| *Alistipes* sp. ZOR0009 | 6 | MSNEIGAFREHQFAYAPGNEKQEEATTATYFNLALSNVEGMMFGEVE<br>SNPDKIEKSLDTLPPAILRQIASFIWLSKEDHPDKAYSTEEVKVIVTDLV<br>RRLCFYRNYFSHCFYLDTQYFYSDELVDTTAIGEKLPYNFHHFITNRLF<br>RYSLPEITXFRWNEGERKYEILRDGLIFFCCLFLKRGQAERFLNELRFF<br>KRTDEEGRIKRTIPFTKYCTRESHKHIGIEEQDFLIFQDIIGDLNRVPKVC<br>DGVVDLSKENERYIKNRETSNESDENKARYRLLIREKDKFPYYLMRYI<br>VDFGVLPCITFKQNDYSTKEGRGQFHYQDAAVAQEERCYNFVVRNG<br>NVYYSYMPQAQNVVRISELQGTISVEELRNMVYASINGKDVNKSVEQ<br>YLYHLHLLYEKILTISGQTIKEGRVDVEDYRPLLDKLLLRPASNGEELR<br>RELRKLLPKRVCDLLSNRFDCSEGVSAVEKRLKAILLRHEQLLLSQNP<br>ALHIDKIKSVIDYLYLFFSDDEKFRQQPTEKAHRGLKDEEFQMYHYLV<br>GDYDSHPLALWKELEASGRLKPEMRKLTSATSLHGLYMLCLKGTVE<br>WCRKQLMSIGKGTAKVEAIADRVGLKLYDKLKEYTPEQLEREVKLV<br>VMHGYAAAATPKPKAQAAIPSKLTELRFYSFLGKREMSFAAFIRQDK<br>KAQKLWLRNFYWENIKTLQKRQAAADAACKKLYNLVGEVERVHT<br>NDKVLVLVAQRYRERLLNVGSKCAVTLDNPERQQKLADVYEVQNA |

| | | |
|---|---|---|
| | | WLSIRFDDLDFTLTHVNLSNLRKAYNLIPRKMLAFKEYLDNRVKQKL<br>CEEECRNVRRKEDLCTCCSPRYSNLTSWLKENHSESSIEREAATMMLL<br>DVERKLLSFLLDERRKAIIEYGKFIPFSALVKECRLADAGLCGIRNDVL<br>HDNVISYADAIGKLSAYFPKEASEAVEYIRRTKEVREQRREELMANSSQ<br>(SEQ ID NO: 97) |
| *Prevotella<br>sp.* MA2016 | 7a | MSKECCKKQRQEKKRRLQKANFSISLTGKHVFGAYFNMARTNFVKTIN<br>YILPIAGVRGNYSENQINKMLHALFLIQAGRNEELTTEQKQWEKKLRL<br>NPEQQTKPQKLLFKHFPVLGPMMADVADHKAYLNKKKSTVQTEDET<br>FAMLKGVSLADCLDIICLMADTLTECRNFYTHKDPYNKPSQLADQYL<br>HQEMIAKKLDKVVVASRRILKDREGLSVNEVEFLTGIDHLHQEVLKD<br>EFGNAKVDGKVMKTFVEYDDFYFKISGKRLVNGYTVTTKDDKPVN<br>VNTMLPALSDFGLLYFCVLFLSKPYAKLFIDEVRLFEYSPFDDKENMI<br>MSEMLSIYRIRTPRLHKIDSHDSKATLAMDIFGELRRCPMELYNLLDK<br>NAGQPFFHDEVKHPNSHTPDVSKRLRYDDRFPTLALRYIDETELFKRI<br>RFQLQLGSFRYKFYDKENCIDGRVRVRRIQKEINGYGRMQEVADKRM<br>DKWGDLIQKREERSVKLEHEELYINLDQFLEDTADSTPYVTDRRPAY<br>NIHANRIGLYWEDSQNPKQYKVFDENGMYIPELVVTEDKKAPIKMPA<br>PRCALSVYDLPAMLFYEYLREQQDNEFPSAEQVIIEYEDDYRKFFKAV<br>AEGKLKPFKRPKEFRDFLKKEYPKLRMADIPKKLQLFLCSHGLCYNN<br>KPETVYERLDRLTLQHLEERELHIQNRLEHYQKDRDMIGNKDNQYGK<br>KSFSDVRHGALARYLAQSMMEWQPTKLKDKEKGHDKLTGLNYNVL<br>TAYLATYGHPQVPEEGFTPRTLEQVLINAHLIGGSNPHPFINKVLALGN<br>RNIEELYLHYLEEELKHIRSRIQSLSSNPSDKALSALPFIHHDRMRYHE<br>RTSEEMMALAARYTTIQLPDGLFTPYILEILQKHYTENSDLQNALSQD<br>VPVKLNPTCNAAYLITLFYQTVLKDNAQPFYLSDKTYTRNKDGEKAE<br>SFSFKRAYELFSVLNNNKKDTFPFEMIPLFLTSDEIQERLSAKLLDGDG<br>NPVPEVGEKGKPATDSQGNTIWKRRIYSEVDDYAEKLTDRDMKISFK<br>GEWEKLPRWKQDKIIKRRDETRRQMRDELLQRMPRYIRDIKDNERTL<br>RRYKTQDMVLFLLAEKMFTNIISEQSSEFNWKQMRLSKVCNEAFLRQ<br>TLTFRVPVTGETTIYVEQENMSLKNYGEFYRFLTDDRLMSLLNNIVE<br>TLKPNENGDLVIRHTDLMSELAAYDQYRSTIFMLIQSIENLIITNNAVL<br>DDPDADGFWVREDLPKRNNFASLLELINQLNNVELTDDERKLLVAIR<br>NAFSHNSYNIDFSLKDVKHLPEVAKGILQHLQSMLGVEITK<br>(SEQ ID NO: 98) |
| *Prevotella<br>sp.* MA2016 | 7b | MSKECCKKQRQEKKRRLQKANFSISLTGKHVFGAYFNMARTNFVKTIN<br>YILPIAGVRGNYSENQINKMLFIALFLIQAGRNEELTTEQKQWEKKLRL<br>NPEQQTKFQKLLFKHFPVLGPMMADVADHKAYLNKKKSTVQTEDET<br>FAMLKGVSLADCLDIICLMADTLTECRNFYTHKDPYNKPSQLADQYL<br>HQEMIAKKLDKVVVASRRILKDREGLSVNEVEFLTGIDFILHQEVLKD<br>EFGNAKVDGKVMKTFVEYDDFYFKISGKRLVNGYTVTTKDDKPVN<br>VNTMLPALSDFGLLYFCVLFLSKPYAKLFIDEVRLFEYSPFDDKENMI<br>MSEMLSIYRIRTPRLHKIDSHDSKATLAMDIFGELRRCPMELYNLLDK<br>NAGQPFFHDEVKHPNSFITPDVSKRLRYDDRFPTLALRYIDETELFKRI<br>RFQLQLGSFRYKFYDKENCIDGRVRVRRIQKEINGYGRMQEVADKRM<br>DKWGDLIQKREERSVKLEHEELYINLDQFLEDTADSTPYVTDRRPAY<br>NIHANRIGLYWEDSQNPKQYKVFDENGMYIPELVVTEDKKAPIKMPA<br>PRCALSWDLPAMLFYEYLREQQDNEFPSAEQVIIEYEDDYRKFFKAV<br>AEGKLKPFKRPKEFRDFLKKEYPKLRMADIPKKLQLFLCSHGLCYNN<br>KPETVYERLDRLTLQFILEERELHIQNRLEFRYQKDRDMIGNKDNQYGK<br>KSFSDVRHGALARYLAQSMMEWQPTKLKDKEKGHDKLTGLNYNVL<br>TAYLATYGHPQVPEEGFTPRTLEQVLINAHLIGGSNPHPFINKVLALGN<br>RNIEELYLHYLEEELKHIRSRIQSLSSNPSDKALSALPF1FWDRMRYHE<br>RTSEEMMALAARYTTIQLPDGLFTPYILEILQKHYTENSDLQNALSQD<br>VPVKLNPTCNAAYLITLFYQTVLKDNAQPFYLSDKTYTRNKDGEKAE<br>SFSFKRAYELFSVLNNNKKDTFPFEMIPLFLTSDEIQERLSAKLLDGDG<br>NPVPEVGEKGKPATDSQGNTPWKRRIYSEVDDYAEKLTDRDMKISFK<br>GEWEKLPRWKQDKIIKRRDETRRQMRDELLQRMPRYIRDIKDNERTL<br>RRYKTQDMVLFLLAEKMFTNIISEQSSEFNWKQMRLSKVCNEAFLRQ<br>TLTFRVPVWGETTIYVEQENMSLKNYGEFYRFLTDDRLMSLLNNIVE<br>TLKPNENGDLVIRHTDLMSELAAYDQYRSTIFMLIQSIENLKIITNNAVL<br>DDPDADGFWVREDLPKRNNFASLLELINQLNNVELTDDERKLLVAIR<br>NAFSHNSYNIDFSLIKDVKHLPEVAKGILQHLQSMLGVEITK<br>(SEQ ID NO: 99) |
| *Riemerella<br>anatipestifer* | 8 | MEKPLLPNVYTLKHKFFWGAFLNIARHNAFITICHINEQLGLKTPSND<br>DKIVDVVCETWNNILNNDHDLLKKSQLTELILKHFPFLTAMCYHPPK<br>KEGKKKGHQKEQQKEKESEAQSQAEALNPSKLIEALEILVNQLHSLR<br>NYYSHKHKKPDAEKDIFKHLYKAFDASLRMVKEDYKAHFTVNLTR<br>DFAHLNRKGKNKQDNPDFNRYRFEKDGFFTESGLLFFTNLFLDKRDA<br>YWMLKKVSGFKASHKQREKMTTEVFCRSRILLPKLRLESRYDHNQM<br>LLDMLSELSRCPKLLYEKLSEENKKHFQVEADGFLDEIEEEQNPFKDT<br>LIRHQDRFPYFALRYLDLNESFKSIRFQVDLGTYFSYCIYDKKIGDEQEK<br>RHLTRTLLSFGRLQDFTEINRPQEWKALTKDLDYKETSNQPFISKTTPH<br>YHITDNKIGFRLGTSKELYPSLEIKDGANRIAKYPYNSGFVAHAFISVH<br>ELLPLMFYQHLTGKSEDLLKETVRHIQRIYKDFEEERINTIEDLEKANQ<br>GRLPLGAFPKQMLGLLQNKQPDLSEKAKIKIEKLIAETKLLSHRLNTK<br>LKSSPKLGKRREKLIKTGVLADWLVKDFMRFQPVAYDAQNQPIKSSK |

|  |  | ANSTEFWFIRRALALYGGEKNRLEGYFKQTNLIGNTNPHPFLNKFNW |
|---|---|---|
|  |  | KACRNLVDFYQQYLEQREKFLEAIKNQPWEPYQYCLLLKIPKENRKN |
|  |  | LVKGWEQGGISLPRGLFTEAIRETLSEDLMLSKPIREIKKHGRVGFIS |
|  |  | RAITLYFKEKYQDKHQSFYNLSYKLEAKAPLLKREEHYEYWQQNKP |
|  |  | QSPTESQRLELHTSDRWKDYLLYKRWQHLEKKLRLYRNQDVMLWL |
|  |  | MTLELTKNHFKELNLNYHQLKLENLAVNVQEADAKLNPNQTLPMV |
|  |  | LPVKVYPATAFGEVQYHKTPIRTVYIREEHTKALKMGNFKALVKDRR |
|  |  | LNGLFSFIKEENDTQKHPISQLRLRRELEIYQSLRVDAFKETLSLEEKLL |
|  |  | NKHTSLSSLENEFRALLEEWKKEYAASSMVTDEHIAFIASVRNAFCHN |
|  |  | QYPFYKEALHAPIPLFTVAQPTTEEKDGLGIAEALLKVLREYCEIVKSQI |
|  |  | (SEQ ID NO: 100) |
| *Prevotella aurantiaca* | 9 | MEDDKKTTGSISYELKDKHFWAAFLNLARHNVYITINHINKLLEIREID |
|  |  | NDEKVLDIKTLWQKGNKDLNQKARLRELMTKHFPPFLETAIYTKNKED |
|  |  | KKEVKQEKQAEAQSLESLKDCLFLFLDKLQEARNYYSHYKYSEFSKE |
|  |  | PEFEEGLLEKMYNIFGNNIQLVINDYQFINKDINPDEDFKHLDRKGQFK |
|  |  | YSFADNEGNITESGLLFFVSLFLEKKDAIWMQQKLNGFKDNLENKKK |
|  |  | MTHEVFCRSRILMPKLRLESTQTQDWILLDMLNELIRCPKSLYERLQG |
|  |  | DDREKFKVPFDPADEDYNAEQEPPKNTLIRHQDRFPYFVLRYFDYNEI |
|  |  | FKNLRFQIDLGTYHFSIYKKLIGGQKEDRHLTHKLYGFERIQEFAKQN |
|  |  | RPDEWKAIVKDLDTYETSNKRYISETTPHYHLENQKIGIRFRNGNKEI |
|  |  | WPSLKTNDENNEKSKYKLDKQYQAEAFLSVHELLPMMFYYLLLKKE |
|  |  | KPNNDEINASIVEGFIKREIRNIFKLYDAFANGEINNIDDLEKYCADKGI |
|  |  | PKRHLPKQMVAILYDEHKDMVKEAKRKQKEMVKDTKKLLATLEKQ |
|  |  | TQKEKEDDGRNVKLLKSGEIARWLVNDMMRFQPVQKDNEGKPLNNS |
|  |  | KANSTEYQMLQRSLALYNNEEKPTRYFRQVNLIESNNPHPFLKWTKW |
|  |  | EECNNILTFYYSYLTKKIEFLNKLKPEDWKKNQYFLKLKEPKTNRETL |
|  |  | VQGWKNGFNLPRGIFTEPIREWFKRHQNNSKEYEKVEALDRVGLVTK |
|  |  | VIPLFFKEEYFKDKEENFKEDTQKEFNDCVQPFYNFPYNVGNIHKPKE |
|  |  | KDFLHREERIELWDKKKDKFKGYKEKIKSKKLTEKDKEEFRSYLEFQS |
|  |  | WNKFERELRLVRNQDIVTWLLCKELIDKLKIDELNIEELKKLRLNNID |
|  |  | TDTAAKKEKNNILNRVMPMELPVTVYEIDDSHKIVKDKPLHTIYIKEAE |
|  |  | TKLLKQGNFKALVKDRRLNGLFSFVKTNSEAESKRNPISKLRVEYELG |
|  |  | EYQEARIEIIQDMLALEEKLINKYKDLPTNKFSEMLNSWLEGKDEADK |
|  |  | ARFQNDVDFLIAVRNAFSHNQYPMHNKIEFANIKPFSLYTANNSEEKG |
|  |  | LGIANQLKDKTKETTDKIKKIEKPIETKE (SEQ ID NO: 101) |
| *Prevotella saccharolytica* | 10 | MEDKPFWAAFFNLARHNVYLTVNHINKLLDLEKLYDEGKHKEIFERE |
|  |  | DIFNISDDVMNDANSNGKKRKLDIKKIWDDLDTDLTRKYQLRELILK |
|  |  | HFPPIQPAIIGAQTKERTTIDKDKRSTSTSNDSLKQTGEGDINDLLSLSN |
|  |  | VKSMFFLLQILEQLRNYYSHVKHSKSATMPNFDEDLLNWMRYIFIDS |
|  |  | VNKVKEDYSSNSVIDPNTSFSHLIYKDEQGKIKPCRYPFTSKDGSINAF |
|  |  | GLLFFVSLFLEKQDSIWMQKKIPGFKKASENYMKMTNEVFCRNHILLP |
|  |  | KIRLETVYDKDWMLLDMLNEVVRCPLSLYKRLTPAAQNKFKVPEKSS |
|  |  | DNANRQEDDNPFSRILVRHQNRFPYFVLRFFDLNEVFTTLRFQINLGC |
|  |  | YHFAICKKQIGDKKEVHHLIRTIYGFSRLQNFTQNTRPEEWNTLVKTT |
|  |  | EPSSGNDGKTVQGVPLPYISYTIPHYQIENEKIGIKIFDGDTAVDTDIWP |
|  |  | SVSTEKQLNKPDKYTLTPGFKADVFLSVHELLPMMFYYQLLLCEGML |
|  |  | KTDAGNAVEKVLIDTRNAIFNLYDAFVQEKINTITDLENYLQDKPILIG |
|  |  | HLPKQMIDLLKGHQRDMLKAVEQKKAMLIKDTERRLKLLDKQLKQE |
|  |  | TDVAAKNTGTLLKNGQIADWLVNDMMRFQPVKRDKEGNPINCSKAN |
|  |  | STEYQMLQRAFAFYATDSCRLSRYFTQLHLIHSDNSHLFLSRFEYDKQ |
|  |  | PNLIAFYAAYLKAKLEFLNELQPQNWASDNYFLLLRAPKNDRQKLAE |
|  |  | GWKNGFNLPRGLFTEKIKWFNEHKTIVDISDCDIFKNRVGQVARLIP |
|  |  | VFFDKKFKDHSQPFYRYDFNVGNVSKPTEANYLSKGKREELFKSYQN |
|  |  | KFKNNIPAEKTKEYREYKNFSLWKKFERELRLIKNQDILIWLMCKNLF |
|  |  | DEKIKPKKDILEPRIAVSYIKLDSLQTNTSTAGSLNALAKVVPMTLAIHI |
|  |  | DSPKPKGKAGNNEKENKEFTVYIKEEGTKLLKWGNFKTLLADRRIKG |
|  |  | LFSYIEHDDIDLKQHPLTKRRVDLELDLYQTCRIDIFQQTLGLEAQLLD |
|  |  | KYSDLNTDNFYQMLIGWRKKEGIPRNIKEDTDFLKDVRNAFSHNQYP |
|  |  | DSKKIAFRRIRKFNPKELILEEEEGLGIATQMYKEVEKVVNRIKRIELFD |
|  |  | (SEQ ID NO: 102) |
| HMPREF9712_03108 [*Myroides odoratimimus* CCUG 10230] | 11 | MKDILTTDTTEKQNRFYSHKIADKYFFGGYFNLASNNIYEVFEEVNKR |
|  |  | NTFGKLAKRDNGNLKNYIIHVFKDELSISDFEKRVAIFASYFPILETVD |
|  |  | KKSIKERNRTIDLTLSQRIRQFREMLISLVTAVDQLRNFYTHYHHSDIVI |
|  |  | ENKVLDFLNSSFVSTALHVKDKYLKTDKTKEFLKETIAAELDILIEAY |
|  |  | KKKQIEKKNTRFKANKREDILNAIYNEAFWSFINDKDKDKETVVA |
|  |  | KGADAYFEKNHHKSNDPDFALNISEKGIVYLLSFFLTNKEMDSLKAN |
|  |  | LTGFKGKVDRESGNSIKYMATQRIYSFHTYRGLKQKIRTSEEGVKETL |
|  |  | LMQMIDELSKVPNVVYQHLSTTQQNSFTEDWNEYYKDYEDDVETDD |
|  |  | LSRVIHPVIRKRYEDRFNYFAIRFLDEFFDFPTLRFQVHLGDYVHDRRT |
|  |  | KQLGKVESDRIIKEKVTVFARLKDINSAKASYFHSLEEQDKEELDNKW |
|  |  | TLFPNPSYDFPKEHTLQHQGEQKNAGIGIYVKLRDTQYKEKAALEE |
|  |  | ARKSLNPKERSATKASKYDIITQIIEANDNVKSEKPLVFTGQPIAYLSM |
|  |  | NDIHSMLFSLLTDNAELKKTPEEVEAKLIDQIGKQINEILSKDTDTKILK |
|  |  | KYKDNDLKETDTKITRDLARDKEEIEKLILEQKQRADDYNYTSSTKF |
|  |  | NIDKSRKRKHLLFNAEKGKIGVWLANDIKRFMFKESKSKWKGYQHT |
|  |  | ELQKLFAYFDTSKSDLELILSNMVMVKDYPIELIDLVKKSRTLVDFLN |

| | | |
|---|---|---|
| | | KYLEARLEYIENVITRVKNSIGTPQFKTVRKECFTFLKKSNYTVVSLDK<br>QVERILSMPLFIERGFMDDKPTMLEGKSYKQHKEKFADWFVHYKENS<br>NYQNFYDTEVYEITTEDKREKAKVTKKIKQQQKNDVFTLMMVNYML<br>EEVLKLSSNDRLSLNELYQTKEERIVNKQVAKDTQERNKNYIWNKVV<br>DLQLCDGLVHIDNVKLKDIGNFRKYENDSRVKEFLTYQSDIVWSAYL<br>SNEVDSNKLYVIERQLDNYESIRSKELLKEVQEIECSVYNQVANKESL<br>KQSGNENFKQYVLQGLLPIGMDVREMLILSTDVKFKKEEIIQLGQAGE<br>VEQDLYSLIYIRNKFAHNQLPIKEFFDFCENNYRSISDNEYYAEYYMEI<br>FRSIKEKYAN (SEQ ID NO: 103) |
| Prevotella<br>intermedia | 12 | MEDDKKTTDSIRYELKDKHFWAAFLNLARHNVYITVNHINKILEEDEI<br>NRDGYENTLENSWNEIKDINKKDRLSKLIIKHFPPFLEATTYRQNPTDTT<br>KQKEEKQAEAQSLESLKKSFFVFIYKLRDLRNHYSHYKHSKSLERPKF<br>EEDLQNKMYNIFDVSIQFVKEDYKHNTDINPKKDFKHLDRKRKGKFH<br>YSFADNEGNITESGLLFFVSLFLEKKDAIWVQKKLEGFKCSNKSYQK<br>MTNEVFCRSRMLLPKLRLESTQTQDWILLDMLNELIRCPKSLYERLQG<br>VNRKKFYVSFDPADEDYDAEQEPFKNTLVRHQDRFPYFALRYFDYNE<br>VFANLRFQIDLGTYHFSIYKKLIGGQKEDRHLTHKLYGFERIQEFDKQ<br>NRPDEWKAIVKDSDTFKKKEEKEEEKPYISETTPHYHLENKKIGIAFK<br>NHNIWPSTQTELTNNKRKKYNLGTSIKAEAFLSVHELLPMMFYYLLL<br>KTENTKNDNKVGGKKETKKQGKHKIEAIIESKIKDIYALYDAFANGEI<br>NSEDELKEYLKGKDIKIVHLPKQMIAILKNEHKDMAEKAEAKQEKMK<br>LATENRLKTLDKQLKGKIQNGKRYNSAPKSGEIASWLVNDMMRFQP<br>VQKDENGESLNNSKANSTEYQLLQRTLAFFGSEHERLAPYFKQTKLIE<br>SSNPHPFLNDTEWEKCSNILSFYRSYLKARKNFLESLKPEDWEKNQYF<br>LMLKEPKTNRETLVQGWKNGFNLPRGFFTEPIRKWFMEHWKSIKVD<br>DLKRVGLVAKVTPLFFSEKYKDSVQPFYNYPFNVGDVNKPKEEDFLH<br>REERIELWDKKKDKFKGYKAKKKFKEMTDKEKEEFHRSYLEFQSWNK<br>FERELRLVRNQDIVTWLLCTELIDKLKIDELNIKELKKLRLKDINTDTA<br>KKEKNNILNRVMPMELPVTVYKVNKGGYIIKNKPLHTIYIKEAETKLL<br>KQGNFKALVKDRRLNGLFSFVKTPSEAESESNPISKLRVEYELGKYQN<br>ARLDIIEDMLALEKXLIDKYNSLDTDNFHNMLTGWLELKGEAKKARF<br>QNDVKLLTAVRNAFSHNQYPMYDENLFGNTERFSLSSSNIIESKGLDIA<br>AKLKEEVSKAAKKIQNEEDNKKEKET (SEQ ID NO: 104) |
| Capnocytophaga<br>canimorsus | 13 | MKNIQRLGKGNEFSPFKKEDKFYFGGFLNLANNNIEDFFKEIITRFGIVI<br>TDENKKPKETFGEKILNEIFKKDISIVDYEKWVNIFADYFPFTKYLSLY<br>LEEMQFKNRVICFRDVMKELLKTVEALRNFYTHYDHEPIKIEDRVFYF<br>LDKVLLDVSLTVKNKYLKTDKTKEFLNQHIGEELKELCKQRKDYLVG<br>KGKRIDKESEIINGIYNNAFKDFICKREKQDDKENHNSVEKILCNKEPQ<br>NKKQKSSATVWELCSKSSSKYTEKSFPNRENDKHCLEVPISQKGIVFL<br>LSFFLNKGEIYALTSNIKGFKAKITKEEPVTYDKNSIRYMATHRMFSFL<br>AYKGLKRKIRTSEINYNEDGQASSTYEKETLMLQMLDELNKVPDVVY<br>QNLSEDVQKTFIEDWNEYLKENNGDVGTMEEEQVIHPVIRKRYRDKF<br>NYFAIRFLDEFAQFPTLRFQVHLGNYLCDKRTKQICDTTTEREVKKKI<br>TVFGIILSELENKKAIFLNEREEIKGWEVFPNPSYDFPKENISVNYKDFP<br>IVGSILDREKQPVSNKKIGIRVKIADELQREIDKAIKEKKLRNPKNRKAN<br>QDEKQKERLVNEIVSTNSNEQGEPVVFIGQPTAYLSMNDIHSVLYEFLI<br>NKISGEALETKTVEKIETQIKQIIGKDATTKILKPYTNANSNSINREKLLR<br>DLEQEQQILKTLLEEQQQREKDKKDKKSKRKHELYPSEKGKVAVWL<br>ANDIKRFMPKAFKEQWRGYHHSLLQKYLAYYEQSKEELKNLLPKEV<br>FKHFPFKLKGYFQQQYLNQFYTDYLKRRLSYVNELLLNIQNFKNDKD<br>ALKATEKECFKFFRKQNYIINPINIQIQSILVYPIFLKRGFLDEKPTMIDR<br>EKFKENKDTEEADWFMHYKNYKEDNYQKFYAYPLEKVEEKEKFKR<br>NKQINKQKKNDVYTLMMVEYIIQKIFGDKFVEENPLVLKGIFQSKAER<br>QQNNTHAATTQERNLNGILNQPKDIKIQGKITVKGVKLKDIGNFRKYE<br>IDQRVNTFLDYEPRKEWMAYLPNDWKEKEKQGQLPPNNVIDRQISKY<br>ETVRSKILLKDVQELEKIISDEIKEEHRHDLKQGKYYNFKYYILNGLLR<br>QLKNENVENYKVFKLNTNPEKVNITQLKQEATDLEQKAFVLTYIRNK<br>FAHNQLPKKEFWDYCQEKYGKIEKEKTYAEYFAEVFKREKEALIK<br>(SEQ ID NO: 105) |
| Porphyromonas<br>gulae | 14 | MTEQSERPYNGTYYTLEDKHFWAAFLNLARHNAYITLTHIDRQLAYS<br>KADITNDQDVLSFKALWKNFDNDLERKSRLRSLILKHFSFLEGAAYG<br>KKLFESKSSGNKSSKNKELTKKEKEELQANALSLDNLKSILFDFLQKL<br>KDFRNYYSHYRHSGSSELPLFDGNMLQRLYNVFDVSVQRVKIDHEHN<br>DEVDPHYHFNHLVRKGKKDRYGHNDNPSFKHHFVDGEGMVTEAGL<br>LFFVSLFLEKRDAIWMQKKIRGFKGGTETYQQMTNEVFCRSRISLPKL<br>KLESLRMDDWMLLDMLNELVRCPKPLYDRLREDDRACFRVPVDILP<br>DEDDTDGGGEDPFKNTLVRHQDRFPYFALRYFDLKKVFTSLRFHIDL<br>GTYHFAIYKKMGEQPEDRHLTRNLYGFGRIQDFAEEHRPEEWKRLV<br>RDLDYFETGDKPYISQTSPHYHIEKGKIGLRFMPEGQHLWPSEVGTT<br>RTGRSKYAQDKRLTAEAFLSVHELMPMMFYYFLLREKYSEEVSAERV<br>QGRIKRVIEDVYAVYDAFARDEINTRDELDACLADKGIRRGHLPROMI<br>AILSQEHKDMEEKIRKKLQEMMADTDHRLDMLDRQTDRKIRIGRKN<br>AGLPKSGVIADWLVRDMMRFQPVAKDASGKPLNNSKANSTEYRMLQ<br>RALALFGGEKERLTPYFRQMNLTGGNNPHPFLHETRWESHTNILSFYR<br>SYLRARKAFLERIGRSDRVENRPFLLLKEPKTDRQTLVAGWKGEFHLP<br>RGIFTEAVRDCLIEMGHDEVASYKEVGFMAKAVPLYFERACEDRVQP |

|  |  | FYDSPFNVGNSLKPKKGRFLSKEEREAEEWERGKERFRDLEAWSYSAA<br>RRIEDAFAGIEYASPGNKKKIEQLLRDLSLWEAFESKLKVRADRINLA<br>KLKKEILEAQEHPYHDFKSWQKFERELRLVKNQDIITWMMCRDLMEE<br>NKVEGLDTGTLYLKDIRPNVQEQGSLNVLNRVKPMRLPVVVYRADS<br>RGHVHKEEAPLATVYIEERDTKLLKQGNFKSFVKDRRLNGLFSFVDT<br>GGLAMEQYPISKLRVEYELAKYQTARVCVFELTLRLEESLLTRYPHLP<br>DESFREMLESWSDPLLAKWPELHGKVRLLIAVRNAFSHNQYPMYDE<br>AVFSSIRKYDPSSPDAIEERMGLNIAHRLSEEVKQAKETVERIIQA<br>(SEQ ID NO: 106) |
| Prevotella<br>sp. P5-125 | 15 | MNIPALVENQKKYFGTYSVMAMLNAQTVLDHIQKVADIEGEQNENN<br>ENLWFHPVMSHLYNAKNGYDKQPEKTMFIIERLQSYFPPFLKIMAENQ<br>REYSNGKYKQNRVEVNSNDIFEVLKRAFGVLKMYRDLTNHYKTYEE<br>KLNDGCEFLTSTEQPLSGMINNYYTVALRNMNERYGYKTEDLAFIOD<br>KRFKFVKDAYGKKKSQVNTGFFLSLQDYNGDTQKKLHLSGVGIALLI<br>CLFLDKQYINIFLSRLPIFSSYNAQSEERRIIRSFGINSIKLPKDRIHSEKS<br>NKSVAMDMLNEVKRCPDELFTTLSAEKQSRFRIISDDHNEVLMKRSS<br>DRFVPLLLQYIDYGKLFDHIRFHVNMGKLRYLLKADKTCIDGQTRVR<br>VIEQPLNGFGRLEEAETMRKQENGTFGNSGIRIRDFENMKRDDANPA<br>NYPYIVDTYTHYILENNKVEMFINDKEDSAPLLPVIEDDRYVVKTIPSC<br>RMSTLEIPAMAFHMFLFGSKKTEKLIVDVHNRYKRLFQAMQKEEVTA<br>ENIASFGIAESDLPQKILDLISGNAHGKDVDAFIRLTVDDMLTDTERRI<br>KRFKDDRKSIRSADNKMGKRGFKQISTGKLADFLAKDIVLFQPSVND<br>GENKITGLNYRIMQSAIAVYDSGDDYEAKQQFKLMFEKARLIGKGTT<br>EPHPFLYKVFARSIPANAVEFYERYLIERKFYLTGLSNEIKKGNRVDVP<br>FIRRDQNKWKTPAMKTLGRIYSEDLPVELPRQMFDNEIKSHLKSLPQM<br>EGIDFNNANVTYLIAEYMKRVLDDDFQTFYQWNRNYRYMDMLKGE<br>YDRKGSLQHCFTSVEEREGLWKERASRTERYRKQASNKIRSNRQMRN<br>ASSEEIETILDKRLSNSRNEYQKSEKVIRRYRVQDALLFLLAKKTLTEL<br>ADFDGERFKLKEIMPDAEKGILSEIMPMSFTFEKGGKKYTITSEGMKL<br>KNYGDFFVLASDKRIGNLLELVGSDIVSKEDIMEEFNKYDQCRPEISSI<br>VFNLEKWAFDTYPELSARVDREEKVDFKSILKILLNNKNINKEQSDILR<br>KIRNAFDHNNYPDKGVVEIKALPEIAMSIKKAFGEYAIMK (SEQ ID<br>NO: 107) |
| Flavobacterium<br>branchiophilum | 16 | MENLNKILDKENEICISKIFNTKGIAAPITEKALDNIKSKQKNDLNKEA<br>RLHYFSIGHSFKQIDTKKVFDYVLIEELKDEKPLKFITLQKDFFTKEFSI<br>KLQKLINSIRNINNHYVHNFNDINLNKIDSNVFHFLKESFELAIIEKYYK<br>VNKKYPLDNEIVLFLKELFIKDENTALLNYFTNLSKDEAIEYILTFTITE<br>NKIWNINNEHNILNIEKGKYLTFEAMLFLITIFLYKNEANHLLPKLYDF<br>KNNKSQELFTFFSKKFTSQDIDAEEGHLIKFRDMIQYLNHYPTAWNN<br>DLKLESENKNKIMTTKLIDSIIEFELNSNYPSFATDIQFKKEAKAFLFAS<br>NKKRNQTSFSNKSYNEEIRHNPHIKQYRDEIASALTPISFNVKEDKFKIF<br>VKKHVLEEYFPNSIGYEKFLEYNDFTEKEKEDFGLKLYSNPKTNKLIE<br>RIDNHKLVKSHGRNQDRFMDFSMRFLAENNYFGKDAFFKCYKFYDT<br>QEQDEFLQSNENNDDVKFHKGKVTTYIKYEEHLKNYSYWDCPFVEE<br>NNSMSVKISIGSEEKILKIQRNLMIYFLENALYNENVENQGYKLVNNY<br>YRELKKDVEESIASLDLIKSNPDFKSKYKKILPKRLLHNYAPAKQDKA<br>PENAFETLLKKADFREEOYKKLLKKAEHEKNKEDFVKRNKGKQFKL<br>HFIRKACQMMYFKEKYNTLKEGNAAFEKKDPVIEKRKNKEHEFGHH<br>KNLNITREEFNDYCKWMFAFNGNDSYKKYLRDLFSEKHFFDNQEYK<br>NLFESSVNLEAFYAKTKELFKKWIETNKPTNNENRYTLENYKNLILQK<br>QVFINVYHFSKYLIDKNLLNSENNVIQYKSLENVEYLISDFYFQSKLSI<br>DQYKTCGKLFNKLKSNKLEDCLLYEIAYNYIDKKNVHKIDIQKILTSKI<br>ILTINDANTPYKISVPFNKLERYTEMIAIKNQNNLKARFLIDLPLYLSKN<br>KIKKGKDSAGYEIIIKNDLEIEDINTINNKIINDSVKFTEVLMELEKYFIL<br>KDKCILSKNYIDNSEIPSLKQFSKVWIKENENEIINYRN1ACHFHLPLLE<br>TFDNLLLNVEQKFIKEELQNVSTINDLSKPQEYILILLFIKFKHNNFYLN<br>LFNKNESKTIKNDKEVKKNRVLQKFINQVILKKK (SEQ ID NO: 108) |
| Myroides<br>odoratimimus | 17 | MKDILTTDTTEKQNRFYSHKIADKYFFGGYFNLASNNIYEVFEEVNKR<br>NTFGKLAKRDNGNLKNYIIHVFKDELSISDFEKRVAIFASYFPILETVD<br>KKSIKERNRTIDLTLSQRIRQFREMLISLVTAVDQLRNFYTHYHHSDVI<br>ENKVLDFLNSSFVSTALHVKDKYLKTDKTKEFLKETIAAELDILIEAY<br>KKKQIEKKNTRFKANKREDILNAIYNEAFWSFINDKDKDKETVVA<br>KGADAYFEKNHHKSNDPDFALNISEKGIVYLLSFFLTNKEMDSLKAN<br>LTGFKGKVDRESGNSIKYMATQRIYSFHTYRGLKQKIRTSEEGVKETL<br>LMQMIDELSKVPNVVYQHLSTTQQNSFIEDWNEYYKDYEDDVETDD<br>LSRVTHPVIRKRYEDRFNYFAIRFLDEFFDFPTLRFQVHLGDYVHDRR<br>TKQLGKVESDRIIKEKVTVFARLKDINSAKASYPHSLEEQDKEELDNK<br>WTLFPNPSYDFPKEHTLQHQGEQKNAGKIGIYVKLRDTQYKEKAALE<br>EARKSLNPKERSATKASKYDIITQIIEANDNVKSEKPLVFTGQPIAYLS<br>MNDIHSMLFSLLTDNAELKKTPEEVEAKLIDQIGKQINEILSKDTDTKI<br>LKKYKDNDLKETDTDKITRDLARDKEEIEKLILEQKQRADDYNYTSST<br>KFNIDKSRKRKHLLFNAEKGKIGVWLANDIKRFMFKESKSKWKGYQ<br>HIELQKLFAYFDTSKSDLELILSNMVVKDYPIELIDLVKKSRTLVDFL<br>NKYLEARLEYIENVITRVKNSIGTPQFKTVRKECFTFLKKSNYTVVSLD<br>KQVERILSMPLFIERGFMDDKPTMLEGKSYKQHKEKFADWFYHYKE<br>NSNYQNFYDTEVYEITTEDKREKAKVTKKIKQQQKNDVFTLMMVNY |

| | | |
|---|---|---|
| Flavobacterium columnare | 18 | MSSKNESYNKQKTFNHYKQEDKYFFGGFLNNADDNLRQVGKEFKTR<br>INFNHNNNELASVFKDYFNKEKSVAKREHALNLLSNYFPVLERIQKHT<br>NHNFEQTREIFELLLDTIKKLRDYYTHHYHKPITINPKIYDFLDDTLLD<br>VLITIKKKKVKNDTSRELLKEKLRPELTQLKNQKREELIKKGKKLLEE<br>NLENAVFNHCLIPPFLEENKTDDKQNKTVSLRKYRKSKPNEETSITLTQ<br>SGLVFLMSFFLHRKEFQVFTSGLERFKAKVNTIKEEEISLNKNNIVYMI<br>THWSYSYYNFKGLKHRIKTDQGVSTLEQNNTTHSSLTNTNTKEALLTQ<br>IVDYLSKVPNEIYETLSEKQQKEFEEDINEYMRENPENEDSTFSSIVSH<br>KVIRKRYENKFNYFAMRFLDEYAELPTLRFMVNFGDYIKDRQKKILES<br>IQFDSERIIKKEIHLFEKLSLVTEYKKNVYLKETSNIDLSRFPLFPNPSYV<br>MANNNIPFYIDSRSNNLDEYLNQKKKAQSQNKKRNLTFEKYNKEQSK<br>DAIIAMLQKEIGVKDLQQRSTIGLLSCNELPSMLYEVIVKDIKGAELEN<br>KIAQKIREQYQSIRDFTLDSPQKDNIPTTLIKTINTDSSVTFENQPIDIPRL<br>KNALQKELTLTQEKLLNVKEHEIEVDNYNRNKNTYKFKNQPKNKVD<br>DKKLORKYVFYRNEIRQEANWLASDLIHFMKNKSLWKGYMHNELQS<br>FLAFFEDKKNDCIALLETVFNLKEDCILTKGLKNLFLKHGNFIDFYKEY<br>LKLKEDFLSTESTFLENGPIGLPPKILKKELSKRLKYIFIVFQKRQFIIKE<br>LEEKKNNLYADAINLSRGIFDEKPTMIPFKKPNPDEFASWFVASYQYN<br>NYQSFYELTPDIVERDKKKKYKNLRAINKVKIQDYYLKLMVDTLYQD<br>LFNQPLDKSLSDFYVSKAEREKIKADAKAYQKLNDSSLWNKVIHLSL<br>QNNRITANPKLKDIGKYKRALQDEKIATLLTYDARTWTYALQKPEKE<br>NENDYKELHYTALNMELQEYEKVRSKELLKQVQELEKKILDKFYDFS<br>NNASHPEDLEIEDKKGKRHPNFKLYITKALLKNESEIINLENIDIEILLK<br>YYDYNTEELKEKIKNMDEDEKAKIINTKENYNKITNVLIKKALVLIIIR<br>NKMAHNQYPPKFIYDLANRFVPKKEEEYFATYFNRVFETITKELWEN<br>KEKKDKTQV (SEQ ID NO: 110) |
| Porphyromonas gingivalis | 19 | MTEQNEKPYNGTYYTLEDKHFWAAFLNLARHNAYITLAHIDRQLAY<br>SKADITNDEDILFFKGQWKNLDNDLERKARLRSLILKHFSFLEGAAYG<br>KKLFESQSSGNKSSKKKELSKKEKEELQANALSLDNLKSILFDFLQKL<br>KDFRNYYSHYRHPESSELPLFDGNMLQRLYNVFDVSVQRVKRDHEH<br>NDKVDPHRHFNHLVRKGKKDKYGNNDNPFFKHHFVDREGTVTEAGL<br>LFFVSLFLEKRDAIWMQKKIRGFKGGTEAYQQMTNEVFCRSRISLPKL<br>KLESLRTDDWMLLDMLNELVRCPKSLYDRLREEDRARFRVPVDILSD<br>EDDTDGTEEDPFKNTLVRHQDRFPYFALRYFDLKKVFTSLRFHIDLGT<br>YHFAIYKKNIGEQPEDRHLTRNLYGFGRIQDFAEEHRPEEWKRLVRDL<br>DYFETGDKPYITQTTPHYHIEKGKIGLRFVPEGQHLWPSPEVGATRTG<br>RSKYAQDKRLTAEAFLSVHELMPMMFYYFLLREKYSEEVSAEKVQG<br>RIKRVIEDVYAVYDAFARDEINTRDELDACLADKGIRRGHLPRQMIAI<br>LSQEHKDMEEKVRKKLQEMIADTDHRLDMLDRQTDRKIRIGRKNAG<br>LPKSGVVADWLVRDMMRFQPVAKDTSGKPLNNSKANSTEYRMLQR<br>ALALFGGEKERLTPYFRQMNLTGGNNPHPFLHETRWESHTNILSFYRS<br>YLEARKAFLQSIGRSDRVENHRFLLLKEPKTDRQTLVAGWKGEFHLP<br>RGIFTEAVRDCLIEMGYDEVGSYKEVGFMAKAVPLYFERASKDRVQP<br>FYDYPFNVGNSLKPKKGRFLSKEKRAEEWESGKERFRLAKLKKEILE<br>AKEHPYHDFKSWQKFERELRLVKNQDIITWMMCRDLMEENKVEGLD<br>TGTLYLKDIRTDVQEQGSLNVLNRVKPMRLPVVVYRADSRGHVHKE<br>QAPLATVYIEERDTKLLKQGNFKSFVKDRRLNGLFSFVDTGALAMEQ<br>YPISKLRVEYELAKYQTARVCAFEQTLELEESLLTRYPHLPDKNFRKM<br>LESWSDPLLDKWPDLHGNVRLLIAVRNAFSHNQYPMYDETLFSSIRK<br>YDPSSPDAIEERMGLNIAHRLSEEVKQAKEMVERIIQA (SEQ ID NO: 111) |
| Porphyromonas sp. COT-052 OH4946 | 20 | MTEQSERPYNGTYYTLEDKHFWAAFLNLARHNAYITLTHIDRQLAYS<br>KADITNDQDVLSFKALWKNFDNDLERKSRLRSLILKHFSFLEGAAYG<br>KKLFESKSSGNKSSKNKELTKKEKEELQANALSLDNLKSILFDFLQKL<br>KDFRNYYSHYRHSESSELPLFDGNMLQRLYNVFDVSVQRVKRDHEH<br>NDKVDPHRHFNHLVRKGKKDRYGHNDNPSFKHHFVDSEGMVTEAG<br>LLFFVSLFLEKRDAIWMQKKIRGFKGGTETYQQMTNEVFCRSRISLPK<br>LKLESLRTDDWMLLDMLNELVRCPKPLYDRLREDDRACFRVPVDILP<br>DEDDTDGGGEDPFKNTLVRHQDRFPYFALRYFDLKKVFTSLRFHIDL<br>GTYHFAIYKKMIGEQPEDRHLTRNLYGFGRIQDFAEEHRPEEWKRLV<br>RDLDYFETGDKPYISQTTPHYHIEKGKIGLRFVPEGQHLWPSPEVGTT<br>RTGRSKYAQDKRLTAEAFLSVHELMPMMFYYFLLREKYSEEVSAEK<br>VQGRIKRVIEDVYAIYDAFARDEINTLKELDACLADKGIRRGHLPKQM<br>IGILSQERKDMEEKVRKKLQEMIADTDHRLDMLDRQTDRKIRIGRKN<br>AGLPKSGVIADWLVRDMMRFQPVAKDTSGKPLNNSKANSTEYRMLQ<br>RALALFGGEKERLTPYFRQMNLTGGNNPHPFLHETRWESHTNILSFYR<br>SYLRARKAFLERIGRSDRVENCPFLLLKEPKTDRQTLVAGWKGEFHLP<br>RGIFTEAVRDCLIEMGYDEVGSYREVGFMAKAVPLYFERACEDRVQP<br>FYDSPFNVGNSLKPKKGRFLSKEDRAEEWERGKERFRDLEAWSHSAA<br>RRIKDAFAGIEYASPGNKKKIEQLLRDLSLWEAFESKLKVRADKINLA<br>KLKKEILEAQEHPYHDFKSWQKFERELRLVKNQDIITWMMCRDLMEE |

| | | |
|---|---|---|
| | | NKVEGLDTGTLYLKDIRPNVQEQGSLNVLNRVKPMRLPVVVYRADS<br>RGHVHKEEAPLATVYIEERDTKLLQGNFKSFVKDRRLNGLFSFVDT<br>GGLAMEQYPISKLRVEYELAKYQTARVCVFELTLRLEESLLSRYPHLP<br>DESFREMLESWSDPLLAKWPELHGKVRLLIAVRNAFSHNQYPMYDE<br>AVFSSIRKYDPSSPDAIEERMGLNIAHRLSEEVKQAKETVERIIQA<br>(SEQ ID NO: 112) |
| Prevotella<br>intermedia | 21 | MEDDKKTKESTNMLDNKHFWAAFLNLARHNVYITVNHINKVLELKN<br>KKDQDIIIDNDQDILAIKTHWEKVNGDLNKTERLRELMTKHFPPFLETAI<br>YTKNKEDKEEVKQEKQAKAQSFDSLKHCLFLFLEKLQEARNYYSHY<br>KYSESTKEPMLEKELLKKMYNIFDDNIQLVIKDYQHNKDINPDEDFKH<br>LDRTEEEFNYYFTTNKKGNITASGLLFFVSLFLEKKDAIWMQQKLRGF<br>KDNRESKKKMTHEVFCRSRMLLPKLRLESTQTQDWILLDMLNELIRC<br>PKSLYERLQGEYRKKFNVPFDSADEDYDAEQEPPFKNTLVRHQDRFPY<br>FALRYFDYNEIFTNLRFQIDLGTYHFSIYKKLIGGQKEDRHLTHKLYGF<br>ERIQEFAKQNRTDEWKAIVKDFDTYETSEEPYISETAPHYHLENOKIGI<br>RFRNDNDEIWPSLKTNGENNEKRKYKLDKQYQAEAFLSVHELLPMM<br>FYYLLLKKEEPNNDKKNASIVEGFIKREIRDIYKLYDAFANGEINNIDD<br>LEKYCEDKGIPKRHLPKQMVAILYDEHKDMAEEAKRKQKEMVKDTK<br>KLLATLEKQTQGEIEDGGRNIRLLKSGEIARWLVNDMMRFQPVQKDN<br>EGNPLNNSKANSTEYQMLQRSLALYNKEEKPTRYFRQVNLINSSNPHP<br>FLKWTKWEECNNILSFYRSYLTKKIEFLNKLKPEDWEKNQYFLKLKE<br>PKTNRETXVQGWKNGFNLPRGIFTEPIREWFKRHQNDSEEYEKVETLD<br>RVGLVTKVIPLFFKKEDSKDKEEYLKKDAQKEINNCVQPFYGFPYNV<br>GNIHKPDEKDFLPSEERKKLWGDKKYKFKGYKAKVKSKKLTDKEKE<br>EYRSYLEFQSWNKFERELRLVRNQDIVTWLLCTELIDKLKVEGLNVEE<br>LKKKLRLKDIDTDTAKQEKNNILNRVMPMQLPVTVYEIDDSHNIVKDR<br>PLHTVYIEETKTKLLKQGNFKALVKDRRLNGLFSFVDTSSETELKSNPI<br>SKSLVEYELGEYQNARIETIKDMLLLEETLIEKYKTLPTDNFSDMLNG<br>WLEGKDEADKARFQNDVKLLVAVRNAFSHNQYPMRNRIAFANINPF<br>SLSSADTSEEKKLDIANQLKDKTHKIIKRIIEIEKPIETKE (SEQ ID<br>NO: 113) |
| PIN17_0200<br>[Prevotella<br>intermedia<br>17] | AFJ07523 | MKMEDDKKTKESTNMLDNKFLFWAAFLNLARHNVYITVNHINKVLEL<br>KNKKDQDIIIDNDQDILAIKTHWEKVNGDLNKTERLRELMTKHFPPFLE<br>TAIYTKNKEDKEEVKQEKQAKAQSFDSLKHCLFLFLEKLQEARNYYS<br>HYKYSESTKEPMLEKELLKKMYNIFDDNIQLVIKDYQHNKDINPDEDF<br>KHLDRTEEEFNYYFTTNKKGNITASGLLFFVSLFLEKKDAIWMQQKL<br>RGFKDNRESKKKMTHEVFCRSRMLLPKLRLESTQTQDWILLDMLNEL<br>IRCPKSLYERLQGEYRKKFNVPFDSADEDYDAEQEPPFKNTLVRHQDR<br>FPYFALRYFDYNEIFTNLRFQIDLGTYHFSIYKKLIGGQKEDRHLTHKL<br>YGFERIQEFAKQNRTDEWKAIVKDFDTYETSEEPYISETAPHYHLENQ<br>KIGIRFRNDNDEIWPSLKTNGENNEKRKYKLDKQYQAEAFLSVHELLP<br>MMFYYLLLKKEEPNNDKKNASIVEGFIKREIRDIYKLYDAFANGEINN<br>IDDLEKYCEDKGIPKRHLPKQMVAILYDEHKDMAEEAKRKQKEMVK<br>DTKKLLATLEKQTQGEIEDGGRNIRLLKSGEIARWLVNDMMRFQPVQ<br>KDNEGNPLNNSKANSTEYQMLQRSLALYNKEEKPTRYFRQVNLINSS<br>NPHPFLKWTKWEECNNILSFYRSYLTKKIEFLNKLKPEDWEKNQYFL<br>KLKEPKTNRETLVQGWKNGFNLPRGIFTEPIREWFKRHQNDSEEYEK<br>VETLDRVGLVTKVIPLFFKKEDSKDKEEYLKKDAQKEINNCVQPFYGF<br>PYNVGNIHKPDEKDFLPSEERKKLWGDKKYKFKGYKAKVKSKKLTD<br>KEKEEYRSYLEFQSWNKFERELRLVRNQDIVTWLLCTELIDKLKVEGL<br>NVEELKKLRLKDIDTDTAKQEKNNILNRVMPMQLPVTVYEIDDSHNI<br>VKDRPLHTYVYIEETKTKLLKQGNFKALVKDRRLNGLFSFVDTSSETEL<br>KSNPISKSLVEYELGEYQNARIETIKDMLLLEETLIEKYKTLPTDNFSD<br>MLNGWLEGKDEADKARFQNDVKLLVAVRNAFSHNQYPMRNRIAFA<br>NINPFSLSSADTSEEKKLDIANQLKDKTHKIIKRIIEIEKPIETKE<br>(SEQ ID NO: 114) |
| Prevotella<br>intermedia | BAU18623 | MEDDKKTTDSISYELKDKFLFWAAFLNLARHNVYITVNHINKVLELKN<br>KKDQDIIIDNDQDILAIKTHWEKVNGDLNKTERLRELMTKHFPPFLETAI<br>YSKNKEDKEEVKQEKQAKAQSFDSLKHCLFLFLEKLQETRNYYSHYK<br>YSESTKEPMLEKELLKKMYNIFDDNIQLVIKDYQHNKDINPDEDFKHL<br>DRTEEDFNYYFTRNKKGNITESGLLFFVSLFLEKKDAIWMQQKLRGF<br>KDNRESKKKMTHEVFCRSRMLLPKLRLESTQTQDWILLDMLNELIRC<br>PKSLYERLQGEDREKFKVPFDPADEDYDAEQEPPFKNTLVRHQDRFPY<br>FALRYFDYNEIFTNLRFQIDLGTFHFSIYKKLIGGQKEDRHLTHKLYGF<br>ERIQEFAKQNRPDEWKAIVKDLDTYETSNERYISETTPHYHLENQKIGI<br>RFRNDNDEIWPSLKTNGENNEKSKYKLDKQYQAEAFLSVHELLPMM<br>FYYLLLKKEEPNNDKKNASIVEGFIKREIRDMYKLYDAFANGEINNID<br>DLEKYCEDKGIPKRHLPKQMVAILYDEHKDMVKEAKRKQRKMVKD<br>TEKLLAALEKQTQEKTEDGGRNIRLLKSGEIARWLVNDMMRFQPVQ<br>KDNEGNPLNNSKANSTEYQMLQRSLALYNKEEKPTRYFRQVNLINSS<br>NPHPFLKWTKWEECNNILSFYRSYLTKKIEFLNKLKPEDWEKNQYFL<br>KLKEPKTNRETLVQGWKNGFNLPRGIFTEPIREWFKRHQNDSKEYEK<br>VEALDRVGLVTKVIPLFFKKEDSKDKEEDLKKDAQKEINNCVQPFYSF<br>PYNVGNIHKPDEKDFLHREERIELWDKKKDKFKGYKAKVKSKKLTD<br>KEKEEYRSYLEFQSWNKFERELRLVRNQDRIVTWLLCTELIDKLKVEGL<br>NVEELKKLRLKDIDTDTAKQEKNNILNRVMPMQLPVTVYEIDDSHNI |

|  |  | VKDRPLHTVYIEETKTKLLKQGNFKALVKDRRLNGLFSFVDTSSEAEL<br>KSNPISKSLVEYELGEYQNARIETIKDMLLLEETLIEKYKNLPTDNFSD<br>MLNGWLEGKDEADKARFQNDVKLLVAVRNAFSHNQYPMRNRIAFA<br>NINPFSLSSADTSEEKKLDIANQLKDKTHKIIKRIIEIEKPIETKE<br>(SEQ ID NO: 115) |
|---|---|---|
| HMPREF6485_0083<br>[*Prevotella*<br>*buccae*<br>ATCC<br>33574] | EFU31981 | MQKQDKLFVDRKKNAIFAFPKYITIMENKEKPEPIYYELTDKHFWAAF<br>LNLARHNVYTTINHINRRLEIAELKDDGYMMGIKGSWNEQAKKLDK<br>KVRLRDLIMKHFPPFLEAAAYEMTNSKSPNNKEQREKEQSEALSLNNL<br>KNVLFIFLEKLQVLRNYYSHYKYSEESPKPIFETSLLKNMYKVFDANV<br>RLVKRDYMHHENIDMQRDFTHLNRKKQVGRTKNIIDSPNFHYHFAD<br>KEGNMTIAGLLFFVSLFLDKKDAIWMQKKLKGFKDGRNLREQMTNE<br>VFCRSRISLPKLKLENVQTKDWMQLDMLNELVRCPKSLYERLREKDR<br>ESFKVPFDTFSDDYNAEEEPFKNTLVRHQDRFPYFVLRYFDLNEIFEQL<br>RFQIDLGTYHFSIYNKRIGDEDEVRHLTHHLYGFARIQDFAPQNOPEE<br>WRKLVKDLDHFETSQEPYISKTAPHYHLENEKIGIKFCSAHNNLFPSL<br>QTDKTCNGRSKFNLGTQFTAEAFLSVHELLPMMFYYLLLTKDYSRKE<br>SADKVEGIIRKEISNIYAIYDAFANNEINSIADLTRRLQNTNILQGHLPK<br>QMISILKGRQKDMGKEAERKIGEMIDDTQRRLDLLCKQTNQKIRIGKR<br>NAGLLKSGKIADWLVNDMMRFQPVQKDQNNIPINNSKANSTEYRML<br>QRALALFGSENFRLKAYFNQMNLVGNDNPHPFLAETQWEHQTNILSF<br>YRNYLEARKKYLKGLKPQNWKQYQHFLILKVQKTNRNTLVTGWKN<br>SFNLPRGIFTQPIREWFEKHNNSKRIYDQILSFDRVGFVAKAIPLYFAEE<br>YKDNVQPFYDYPFNIGNRLKPKKRQFLDKKERVELWQKNKELFKNY<br>PSEKKKTDLAYLDFLSWKKFERELRLIKNQDIVTWLMFKELFNMATV<br>EGLKIGEIHLRDIDTNTANEESNNILNRIMPMKLPVKTYETDNKGNILK<br>ERPLATFYIEETETKVLKQGNFKALVKDRRLNGLFSFAETTDLNLEEH<br>PISKLSVDLELIKYQTTRISIFEMTLGLEKKLIDKYSTLPTDSFRNMLER<br>WLQCKANRPELKNYVNSLIAVRNAFSHNQYPMYDATLFAEVKKFTL<br>FPSVDTKKIELNIAPQLLEIVGKAIKEIEKSENKN (SEQ ID NO: 116) |
| HMPREF9144_1146<br>[*Prevotella*<br>*pallens*<br>ATCC<br>700821] | EGQ18444 | MKEEEKGKTPVVSTYNKDDKHFWAAFLNLARHNVYITVNHINKILGE<br>GEINRDGYENTLEKSWNEIKDINKKDRLSKLIIKHFPPFLEVTTYQRNSA<br>DTTKQKEEKQAEAQSLESLKKSFFVFIYKLRDLRNHYSHYKHSKSLER<br>PKFEEDLQEKMYNIFDASIQLVKEDYKHNTDIKTEEDFKHLDRKGQFK<br>YSFADNEGNITESGLLFFVSLFLEKKDAIWVQKKIEGFKCSNESYQKM<br>TNEVFCRSRMLLPKLRLQSTQTQDWILLDMLNELIRCPKSLYERLREE<br>DRKKFRVPIEIADEDYDAEQEPFKNALVRHQDRFPYFALRYFDYNEIF<br>TNLRFQIDLGTYHFSIYKKQIGDYKESHHLTHKLYGFERIQEFTKQNRP<br>DEWRKFVKTFNSFETSKEPYIPETTPHYHLENQKIGIRFRNDNDKIWPS<br>LKTNSEKNEKSKYKLDKSFQAEAFLSVHELLPMMFYYLLLKTENTDN<br>DNEIETKKKENKNDKEKHKIEEIIENKITEIYALYDAFANGKINSIDKL<br>EEYCKGKDIEIGHLPKQMIAILKSEHKDMATEAKRKQEEMLADVQKS<br>LESLDNQINEEIENVERKNSSLKSGEIASWLVNDMMRFQPVQKDNEG<br>NPLNNSKANSTEYQMLQRSLALYNKEEKPTRYFRQVNLIESSNPHPFL<br>NNTEWEKCNNILSFYRSYLEAKKNFLESLKPEDWEKNQYFLMLKEPK<br>TNCETLVQGWKNGFNLPRGIFTEPIRKWFMEHRKNITVAELKRVGLV<br>AKVIPLFFSEEYKDSVQPFYNYLFNVGNINKPDEKNFLNCEERRELLR<br>KKKDEFKKMTDKEKEENPSYLEFQSWNKFERELRLVRNQDIVTWLLC<br>MELFNKKKIKELNVEKIYLKNINTNTTKKEKNTEEKNGEEKIIKEKNNI<br>LNRIMPMRLPIKVYGRENFSKNKKKKIRRNTFFTVYIEEKGTKLLKQG<br>NFKALERDRRLGGLFSFVKTHSKAESKSNTISKSRVEYELGEYQKARI<br>EIIKDMLALEETLIDKYNSLDTDNFHNMLTGWLKLKDEPDKASFQND<br>VDLLIAVRNAFSHNQYPMRNRIAFANINPFSLSSANTSEEKGLGIANQL<br>KDKTHKTIEKIIEIEKPIETKE (SEQ ID NO: 117) |
| HMPREF9714_02132<br>[*Myroides*<br>*odoratimimus*<br>CCUG<br>12901] | EHO08761 | MKDILTTDTTEKQNRFYSHKIADKYFFGGYFNLASNNIYEVFEEVNKR<br>NTFGKLAKRDNGNLKNYIIHVFKDELSISDFEKRVAIFASYFPILETVD<br>KKSIKERNRTIDLTLSQRIRQFREMLISLVTAVDQLRNFYTHYHHSEIVI<br>ENKVLDFLNSSLVSTALHVKDKYLKTDKTKEFLKETIAAELDILIEAY<br>KKKQIEKKNTRFKANKREDILNAIYNEAFWSFINDKDKDKETVVAKG<br>ADAYFEKNHHKSNDPDFALNISEKGIVYLLSFFLTNKEMDSLKANLTG<br>FKGKVDRESGNSIKYMATQRIYSPHTYRGLKQKIRTSEEGVKETLLMQ<br>MIDELSKVPNVVVQHLSTTQQNSFIEDWNEYYKDYEDDVETDDLSRV<br>IHPVIRKRYEDRFNYFAIRFLDEFFDFPTLRFQVHLGDYVHDRRTKQL<br>GKVESDRIIKEKVTVFARLKDINSAKANYFHSLEEQDKEELDNKWTLF<br>PNPSYDFPKEHTLQHQGEQKNAGKIGIYVKLRDTQYKEKAALEEARK<br>SLNPKERSATKASKYDIITQIIEANDNVKSEKPLVFTGQPIAYLSMNDIH<br>SMLFSLLTDNAELKKTPEEVEAKLIDQIGKQINEILSKDTDTKILKKYK<br>DNDLKETDTKITRDLARDKEEIEKLILEQKQRADDYNYTSSTKFNID<br>KSRKRKHLLFNAEKGKIGVWLANDIKRFMTEEFKSKWKGYQHTELQ<br>KLFAYYDTSKSDLDLILSDMVMVKDYPIELIALVKKSRTLVDFLNKYL<br>EARLGYMENVITRVKNSIGTPQFKTVRKECFTFLKKSNYTVVSLDKQ<br>VERILSMPLFIERGFMDDKPTMLEGKSYQQHKEKFADWFVHYKENSN<br>YQNFYDTEVYEITTEDKREKAKVTKKIKQQQKNDVFTLMMVNYMLE<br>EVLKLSSNDRLSLNELYQTKEERIVNKQVAKDTQERNKNYIWNKVVD<br>LQLCEGLVRIDKVKLKDIGNFRKYENDSRVKEFLTYQSDIVWSAYLSN<br>EVDSNKLYVIERQLDNYESIRSKELLKEVQEIECSVYNQVANKESLKQ<br>SGNENFKQYVLOGLVPIGMDVREMLILSTDVKFIKEEIIQLGQAGEVE |

| | | |
|---|---|---|
| | | QDLYSLIYIRNKFAHNQLPIKEFFDFCENNYRSISDNEYYAEYYMEIFR SIKEKYTS (SEQ ID NO: 118) |
| HMPREF9711_00870 [*Myroides odoratimimus* CCUG 3837] | EKB06014 | MKDILTTDTTEKQNRFYSHKIADKYFFGGYFNLASNNIYEVFEEVNKR NTFGKLAKRDNGNLKNYIIHVFKDELSISDFEKRVAIFASYFPILETVD KKSIKERNRTIDLTLSQRIRQFREMLISLVTAVDQLRNFYTHYHHSEIVI ENKVLDFLNSSLVSTALHVKDKYLKTDKTKEFLKETIAAELDILIEAY KKKQIEKKNTRFKANKREDILNAIYNEAFWSFINDKDKDKETVVAKG ADAYFEKNHHKSNDPDFALNISEKGIVYLLSFFLTNKEMDSLKANLTG FKGKVDRESGNSIKYMATQRIYSFHTYRGLKQKIRTSEEGVKETLLMQ MIDELSKVPNVVVQHLSTTQQNSFIEDWNEYYKDYEDDVETDDLSRV IHPVIRKRYEDRFNYFAIRFLDEFFDFPTLRFQVHLGDYVHDRRTKQL GKVESDRIIKEKVTVFARLKDINSAKANYFHSLEEQDKEELDNKWTLF PNPSYDFPKEHTLQHQGEQKNAGKIGIYVKLRDTQYKEKAALEEARK SLNPKERSATKASKYDIITQIIEANDNVKSEKPLVFTGQPIAYLSMNDIH SMLFSLLTDNAELKKTPEEVEAKLIDQIGKQINEILSKDTDTKILKKYK DNDLKETDTDKITRDLARDKEEIEKLILEQKQRADDYNYTSSTKFNID KSRKRKHLLFNAEKGKIGVWLANDIKRFMTEEFKSKWKGYQHTELQ KLFAYYDTSKSDLDLILSDMVMVKDYPIELIALVKKSRTLVDFLNKYL EARLGYMENVITRVKNSIGTPQFKTVRKECFTFLKKSNYTVVSLDKQIE RILSMPLFIERGFMDDKPTMLEGKSYQQHKEDFADWFVHYKENSNYQ NFYDTEVYEIITEDKREQAKVTKKIKQQQKNDVFTLMMVNYMLEEV LKLSSNDRLSLNELYQTKEERIVNKQVAKDTQERNKNYIWNKVVDLQ LCEGLVRIDKVKLKDIGNFRKYENDSRVKEFLTYQSDIVWSGYLSNEV DSNKLYVIERQLDNYESIRSKELLKEVQEIECIVYNQVANKESLKQSG NENFKQYVLQGLLPRGTDVREMLILSTDVKFKKEEIMQLGQVREVEQ DLYSLIYIRNKFAHNQLPIKEFFDFCENNYRPISDNEYYAEYYMEIFRSI KEKYAS (SEQ ID NO: 119) |
| HMPREF9699_02005 [*Bergeyella zoohelcum* ATCC 43767] | EKB54193 | MENKTSLGNNIYYNPFKPQDKSYFAGYFNAAMENTDSVFRELGKRLK GKEYTSENFFDAIFKENISLVEYERYVKLLSDYFPMARLLDKKEVPIKE RKENFKKNFKGIIKAVRDLRNFYTHKEHGEVEITDEIFGVLDEMLKST VLTVKKKKVKTDKTKEILKKSIEKQLDILCQKKLEYLRDTARKIEEKR RNQRERGEKELVAPFKYSDKRDDLIAAIYNDAFDVYIDKKKDSLKESS KAKYNTKSDPQQEEGIDLKIPISKNGVVFLLSLFLTKQETHAFKSKIAGF KATVIDEATVSEATVSHGKNSICFMATHEIFSHLAYKKLKRKVRTAEI NYGEAENAEQLSVYAKETLMMQMLDELSKVPDVVYQNLSEDVQKT FIEDWNEYLKENNGDVGTMEEEQVIHPVIRKRYEDKFNYFAIRFLDEF AQFPTLRFQVHLGNYLHDSRPKENLISDRRIKEKITVFGRLSELEHKKA LFIKNTETNEDREHYWEIFPNPNYDFPKENISVNDKDFPIAGSILDREK QPVAGKIGIKVKLLNQQYVSEVDKAVKAHQLKQRKASKPSIQNIIEEI VPINESNPKEAIVFGGQPTAYLSMNDIHSILYEFFDKWEKKKEKLEKK GEKELRKEIGKELEKKEVGKIQAQIQQIIDKDTNAKILKPYQDGNSTAI DKEKLIKDLKQEQNILQKLKDEQTVREKEYNDFIAYQDKNREINKVR DRNHKQYLKDNLKRKYPEAPARKEVLYYREKGKVAVWLANDIKRF MPTDFKNEWKGEQHSLLQKSLAYYEQCKEELKNLLPEKVFQHLPFKL GGYFQQKYLYQFYTCYLDKRLEYISGINQQAENFKSENKVFKKVENE CFKFLKKQNYTHKELDARVQSILGYPIFLERGFMDEKPTIIKGKTFKGN EALFADWFRYYKEYQNFQTFYDTENYPLVELEKKQADRKRKTKIYQ QKKNDVFTLLMAKHIFKSVFKQDSIDQFSLEDLYQSREERLGNQERAR QTGERNTNYIWNKTVDLKLCDGKITVENVKLKNVGDFIKYEYDQRV QAFLKYEENIEWQAFLIKESKEEENYPYVVEREIEQYEKVRREELLKE VHLIEEYILEKVKDKEILKKGDNQNFKYYILNGLLKQLKNEDVESYKV FNLNTEPEDVNINQLKQEATDLEQKAFVLTYIRNKFAHNQLPKKEFW DYCQEKYGKIEKEKTYAEYFAEVFKKEKEALIK (SEQ ID NO: 120) |
| HMPREF9151_01387 [*Prevotella saccharolytica* F0055] | EKY00089 | MMEKENVQGSHIYYEPTDKCFWAAFYNLARHNAYLTIAHINSFVNSK KGINNDDKVLDIIDDWSKFDNDLLMGARLNKLILKHFPPFLKAPLYQL ARKRTRKQQGKEQQDYEKKGDEDPEVIQEAIANAFKMANVRKTLHA FLKQLEDLRNHFSHYNYNSPAKKMEVKFDDGFCNKLYYVFDAALQM VKDDNRMNPEINMQTDFEHLVRLGRNRKIPNTFKYNFTNSDGTINNN GLLFFVSLFLEKRDAIWMQKKIKGFKGGTENYMRMTNEVFCRNRMVI PKLRLETDYDNHQLMFDMLNELVRCPLSLYKRLKQEDQDKFRVPIEF LDEDNEADNPYQENANSDENPTEETDPLKNTLVRHQHRFPYFVLRYF DLNEVFKQLRFQINLGCYHFSIYDKTIGERTEKRHLTRTLFGFDRLQNF SVKLQPEHWKNMVKHLDTEESSDKPYLSDAMPHYQIENEKIGIHFLK TDTEKKETVWPSLEVEEVSSNRNKYKSEKNLTADAFLSTHELLPMMF YYQLLSSEEKTRAAAGDKVQGVLQSYRKKIFDIYDDFANGTINSMQK LDERLAKDNLLRGNMPQQMLAILEHQEPDMEQKAKEKLDRLITETKK RIGKLEDQFKQKVRIGKRRADLPKVGSIADWLVNDMMRFQPAKRNA DNTGVPDSKANSTEYRLLQEALAFYSAYKDRLEPYFRQVNLIGGTNP HPFLHRVDWKKCNHLLSFYHDYLEAKEQYLSHLSPADWQKHQHFLL LKVRKDIQNEKKDWKKSLVAGWKNGFNLPRGLFTESIKTWTSTDAD KVQITDTKLFENRVGLIAKLIPLYYDKVYNDKPQPFYQYPFNINDRYK PEDTRKRFTAASSKLWNEKKMLYKNAQPDSSDKIEYPQYLDFLSWKK LERELRMLRNQDMMVWLMCKDLFAQCTVEGVEFADLKLSQLEVDV NVQDNLNVLNNVSSMILPLSVYPSDAQGNVLRNSTSKPLHTVYVQENNT KLLKQGNFKSLLKDRRLNGLFSFIAAEGEDLQQHPLTKNRLEYELSIY QTMRISVFEQTLQLEKAILTRNKTLCGNNFNNLLNSWSEHRTDKKTL |

| | | QPDIDFLIAVRNAFSHNQYPMSTNTVMQGIEKFNIQTPKLEEKDGLGIA<br>SQLAKKTKDAASRLQNIINGGTN (SEQ ID NO: 121) |
|---|---|---|
| A343_1752<br>[*Porphyromonas*<br>*gingivalis*<br>JCVI<br>SC001] | EOA10535 | MTEQNEKPYNGTYYTLEDKHFWAAFFNLARHNAYITLTHINDRQLAYS<br>KADITNDEDILFFKGQWKNLDNDLERKARLRSLILKHFSFLEGAAYGK<br>KLFESQSSGNKSSKKKELTKKEKEELQANALSLDNLKSILFDFLQKLK<br>DFRNYYSHYRHPESSELPLFDGNMLQRLYNVFDVSVQRVKRDHEHN<br>DKVDPHRHFNHLVRKGKKDRCGNNDNPFFKHHFVDREEKVTEAGLL<br>FFVSLFLEKRDAIWMQKKIRGFKGGTETYQQMTNEVFCRSRTSLPKLK<br>LESLRTDDWMLLDMLNELVRCPKSLYDRLREEDRARFRVPVDILSDE<br>DDTDGTEEDPFKNTLVRHQDRFPYFALRYFDLKKVFTSLRFHIDLGTY<br>HFAIYKKNIGEQPEDRHLTRNLYGFGRIQDFAEEHRPEEWKRLVRDLD<br>YFETGDKPYITQTTPHYHIEKGKIGLRFVPEGQLLWPSPEVGATRTGRS<br>KYAQDKRFTAEAFLSVHELMPMMFYYFLLREKYSEEASAERVQGRIK<br>RVIEDVYAVYDAFARGEIDTLDRLDACLADKGIRRGHLPRQMIAILSQ<br>EHKDMEEKVRKKLQEMIADTDHRLDMLDRQTDRKIRIGRKNAGLPK<br>SGVIADWLVRDMMRFQPVAKDTSGKPLNNSKANSTEYRMLQRALAL<br>FGGEKERLTPYFRQMNLTGGNNPHPFLHETRWESHTNILSFYRSYLKA<br>RKAFLQSIGRSDRVENHRFLLLKEPKTDRQTLVAGWKGEFHLPRGIFT<br>EAVRDCLIEMGLDEVGSYKEVGFMAKAVPLYFERACKDRVQPFYDY<br>PFNVGNSLKPKKGRFLSKEKRAEEWESGKERFRDLEAWSHSAARRIE<br>DAFAGIENASRENKKKIEQLLQDLSLWETFESKLKVKADKINIAKLKK<br>EILEAKEHPYLDFKSWQKFERELRLVKNQDIITWMMCRDLMEENKVE<br>GLDTGTLYLKDIRTDVHEQGSLNVLNRVKPMRLPVVVYRADSRGHV<br>HKEQAPLATVYIEERDTKLLKQGNFKSFVKDRRLNGLFSFVDTGALA<br>MEQYPISKLRVEYELAKYQTARVCAFEQTLELEESLLTRYPHLPDKNF<br>RKMLESWSDPLLDKWPDLHGNVRLLIAVRNAFSHNQYPMYDETLFSS<br>IRKYDPSSPDAIEERMGLNIAHRLSEEVKQAKEMVERIIQA (SEQ ID<br>NO: 122) |
| HMPREF1981_03090<br>[*Bacteroides*<br>*pyogenes*<br>F0041] | ERI81700 | MESIKNSQKTGKTLQKDPPYFGLYLNMALLNVRKVENFIIRKWLGD<br>VALLPEKSGFHSLLTTDNLSSAKWTRFYYKSRKFLPFLEMFDSDKKSY<br>ENRRETTECLDTIDRQKISSLLKEVYGKLQDIRNAFSHYHIDDQSVKHT<br>ALIISSEMHRFIENAYSFALQKTRARFTGVFVETDFLQAEEKGDNKKFF<br>AIGGNEGIKLKDNALIFLICLFLDREEEAFKLSRATGFKSTKEKGFLAV<br>RETFCALCCRQPHERLLSVNPREALLMDMLNELNRCPDILFEMLDEK<br>DQKSFLPLLGEEEQAHILENSLNDELCEAIDDPFEMTASLSKRYRYKNR<br>FPYLMLRYIEEKNLLPFIRFRIDLGCLELASYPKKMGEENNYERSVTDH<br>AMAFGRLTDFHNEDAVLOQITKGITDEVRFSLYAPRYAIYNNKIGFVR<br>TGGSSDKISFPTLKKKGGEGHCVAYTLQNTKSFGPISIYDLRKILLLSFL<br>DKDKAKNIVSGLLEQCEKHWKDLSENLFDAIRTELQKEFPVPLIRYTL<br>PRSKGGKLVSSKLADKQEKYESEFERRKEKLTEILSEKDFDLSQIPRRM<br>IDEWLNVLPTSREKKLKGYVETLKLDCRERLRVFEKREKGEHPVPPRI<br>GEMATDLAKDIIRMVIDQGVKQRITSAYYSEIQRCLAQYAGDDNRRH<br>LDSIIRELRLKDTKNGHPFLGKVLRPGLGHTEKLYQRYFEEKKEWLEA<br>TFYPAASPKILVPRFVNPPTGKQKELPLIIRNLMKERPEWRDWKQRKN<br>SHPIDLPSQLFENEICRLLKDKIGKEPSGKLKWNEMFKLYWDKEFPNG<br>MQRFYRCKRRVEVFDKVVEYEYSEEGGNYKKYYEALIDEVVRQKISS<br>SKEKSKLQVEDLTLSVRRVFKRAINEKEYQLRLLCEDDRLLFMAVRD<br>LYDWKEAQLDLDKIDNMLGEPVSVSQVIQLEGGQPDAVIKAECKLKD<br>VSKLMRYCYDGRVKGLMPYFANHEATQEQVEMELRHYEDHRRRVF<br>NWVFALEKSVLKNEKLRRFYEESQGGCEHRRCIDALRRKASLVSEEEY<br>EFLVFHIRNKSAHNQFPDLEIGKLPPNVTSGFCECIWSKYKAIICRIIPFID<br>PERRFFGKLLEQK (SEQ ID NO: 123) |
| HMPREF1553_02065<br>[*Porphyromonas*<br>*gingivalis*<br>F0568] | ERJ65637 | MNTVPASENKGQSRTVEDDPQYFGLYLNLARENLIEVESFIVRIKFGK<br>KKLNEESLKQSLLCDHLLSVDRWTKWGHSRRYLPFLHYFDPDSQIE<br>KDHDSKTGVDPDSAQRLIRELYSLLDFLRNDFSHNRLDGTTFEHLEVS<br>PDISSFITGTYSLACGRAQSRFADFFKPDDFVLAKNRKEQLISVADGKE<br>CLTVSGLAFFICLFLDREQASGMLSRIRGFKRTDENWARAVHETFCDL<br>CIRHPHDRLESSNTKEALLLDMLNELNRCPRILYDMLPEEERAQFLPA<br>LDENSMNNLSENSLNEESRLLWDGSSDWAEALTKRIRHQDRFPYLML<br>RFIEEMDLLKGIRFRVDLGEIELDSYSKKVGRNGEYDRTITDHALAFG<br>KLSDFQNEEEVSRMSGEASYPVTLFSLFAPRYALYDNKIGYCHTSDPVY<br>PKSKTGEKRALSNPRSMGPISVHDLRKLLLMELLCEGSFSRMQSDFLR<br>KANRILDETAEGKLQFSALFPEMRHRFIPPQNPKSKDRREKAETTLEK<br>YKQEIKGRKDKLNSQLLSAFDMDQRQLPSRLLDEWMNIRPASHSVKL<br>RTYVKQLNEDCRLRLQKFRKDGDGKARAIPLVGEMATFLSQDIVRMII<br>SEETKKLITSAYYNEMQRSLAQYAGEENRFTQFRAIVAELRLLDPSSGH<br>PFLSATMETAHRYTEDFYKCYLEKKREWLAKTFYRPEQDENTKRRIS<br>VFFVPDGEARKLLPLLIRRRMKEQNDLQDWIRNKQAHPIDLPSHLFDS<br>KIMELLKVKDGKKKWNEAFKDWWSTKYPDGMQPFYGLRRELNIHG<br>KSVSYIPSDGKKFADCYTHLMEKTVQDKKRELRTAGKPVPPDLAADI<br>KRSFHRAVNEREFMLRLVQEDDRLMLMAINKMMTDREEDILPGLKNI<br>DSILDEENQFSLAVHAKVLEKEGEGGDNSLSLVPATIEIKSKRKDWSK<br>YIRYRYDRRVPGLMSHFPEHKATLDEVKTLLGEYDRCRIKIFDWAFAL<br>EGAIMSDRDLKPYLHESSSREGKSGEHSTLVKMLVEKKGCLTPDESQ<br>YLILIRNKAAHNQFPCAAEMPLIYRDVSAKVGSIEGSSAKDLPEGSSLV<br>DSLWKKYEMIIRKILPILDPENRFFGKLLNNMSQPINDL<br>(SEQ ID NO: 124) |

| | | |
|---|---|---|
| HMPREF1988_01768 [*Porphyromonas gingivalis* F0185] | ERJ81987 | MNTVPASENKGQSRTVEDDPQYFGLYLNLARENLIEVESFIVRIKFGK KKLNEESLKQSLLCDHLLSVDRWTKVYGHSRRYLPFLHYFDPDSQIE KDHDSKTGVDPDSAQRLIRELYSLLDFLRNDFSHNRLDGTTFEHLEVS PDISSFITGTYSLACGRAQSRFADFFKPDDFVLAKNRKEQLISVADGKE CLTVSGLAFFICLFLDREQASGMLSRIRGFKRTDENWARAVHETFCDL CIRHPHDRLESSNTKEALLLDMLNELNRCPRILYDMLPEEERAQFLPA LDENSMNNLSENSLNEESRLLWDGSSDWAEALTKRIRHQDRFPYLML RFIEEMDLLKGIRFRVDLGEIELDSYSKKVGRNGEYDRTITDHALAFG KLSDFQNEEEVSRMSGEASYPVTLFSLFAPRYALYDNKIGYCHTSDPVY PKSKTGEKRALSNPRSMGFISVHDLRKLLLMELLCEGSFSRMQSDFLR KANRILDETAEGKLQFSALFPEMRHRFIPPQNPKSKDRREKAETTLEK YKQEIKGRKDKLNSQLLSAFDMDQRQLPSRLLDEWMNIRPASHSVKL RTYVKQLNEDCRLRLQKFRKDGDGKARAIPLVGEMATFLSQDIVRMII SEETKKLITSAYYNEMQRSLAQYAGEENRFTQFRAIVAELHLLDPSSGH PFLSATMETAHRYTEDFYKCYLEKKREWLAKTFYRPEQDENTKRRIS VFFVPDGEARKLLPLLIRRRMKEQNDLQDWIRNKQAHPIDLPSHLFDS KIMELLKVKDGKKKWNEAFKDWWSTKYPDGMQPFYGLRRELNIHG KSVSYIPSDGKKFADCYTHLMEKTVQDKKRELRTAGKPVPPDLAADI KRSFHRAVNEREFMLRLVQEDDRLMLMAINKMMTDREEDILPGLKNI DSILDEENQFSLAVHAKVLEKEGEGGDNSLSLVPATIEIKSKRKDWSK YIRYRYDRRVPGLMSHFPEHKATLDEVKTLLGEYDRCRIKIFDWAFAL EGAIMSDRDLKPYLHESSSREGKSGEHSTLVKMLVEKKGCLTPDESQ YLILIRNKAAHNQFPCAAEMPLIYRDVSAKVGSIEGSSAKDLPEGSSLV DSLWKKYEMIIRKILPILDPENRFFGKLLNNMSQPINDL (SEQ ID NO: 125) |
| HMPREF1990_01800 [*Porphyromonas gingivalis* W4087] | ERJ87335 | MNTVPASENKGQSRTVEDDPQYFGLYLNLARENLIEVESFIVRIKFGK KKLNEESLKQSLLCDHLLSVDRWTKVYGHSRRYLPFLHYFDPDSQIE KDHDSKTGVDPDSAQRLIRELYSLLDFLRNDFSHNRLDGTTFEHLEVS PDISSFITGTYSLACGRAQSRFADFFKPDDFVLAKNRKEQLISVADGKE CLTVSGLAFFICLFLDREQASGMLSRIRGFKRTDENWARAVHETFCDL CIRHPHDRLESSNTKEALLLDMLNELNRCPRILYDMLPEEERAQFLPA LDENSMNNLSENSLNEESRLLWDGSSDWAEALTKRIRHQDRFPYLML RFIEEMDLLKGIRFRVDLGEIELDSYSKKVGRNGEYDRTITDHALAFG KLSDFQNEEEVSRMSGEASYPVTLFSLFAPRYALYDNKIGYCHTSDPVY PKSKTGEKRALSNPRSMGFISVHDLRKLLLMELLCEGSFSRMQSDFLR KANRILDETAEGKLQFSALFPEMRHRFIPPQNPKSKDRREKAETTLEK YKQEIKGRKDKLNSQLLSAFDMDQRQLPSRLLDEWMNIRPASHSVKL RTYVKQLNEDCRLRLQKFRKDGDGKARAIPLVGEMATFLSQDIVRMII SEETKKLITSAYYNEMQRSLAQYAGEENRFTQFRAIVAELRLLDPSSGH PFLSATMETAHRYTEDFYKCYLEKKREWLAKTFYRPEQDENTKRRIS VFFVPDGEARKLLPLLIRRRMKEQNDLQDWIRNKQAHPIDLPSHLFDS KVMELLKVKDGKKKWNEAFKDWWSTKYPDGMQPFYGLRRELNIHG KSVSYIPSDGKKFADCYTHLMEKTVQDKKRELRTAGKPVPPDLAAYI KRSFHRAVNEREFMLRLVQEDDRLMLMAINKIMTDREEDILPGLKNI DSILDKENQFSLAVHAKVLEKEGEGGDNSLSLVPATIEIKSKRKDWSK YIRYRYDRRVPGLMSHFPEHKATLDEVKTLLGEYDRCRIKIFDWAFAL EGAIMSDRDLKPYLHESSSREGKSGEHSTLVKMLVEKKGCLTPDESQ YLILIRNKAAHNQFPCAAEIPLIYRDVSAKVGSIEGSSAKDLPEGSSLV DSLWKKYEMIIRKILPILDPENRFFGKLLNNMSQPINDL (SEQ ID NO: 126) |
| M573_117042 [*Prevotella intermedia* ZT] | KJJ86756 | MKMEDDKKTTESTNMLDNKHFWAAFLNLARHNVYITVNHINKVLEL KNKKDQDIIIDNDQILAIKTHWEKVNGDLNKTERLRELMTKHFPPFLE TAIYTKNKEDKEEVKQEKQAEAQSLESLKDCLFLFLEKLQEARNYYS HYKYSESTKEPMLEEGLLEKMYNIFDDNIQLVIKDYQHNKDINPDEDF KHLDRKGQPKYSFADNEGNITESGLLFFVSLFLEKKDAIWMQQKLTG FKDNRESKKKMTHEVFCRRRMLLPKLRLESTQTQDWILLDMLNELIR CPKSLYERLQGEYRKKFNVPFDSADEDYDAEQEPFKNTLVRHQDRFP YFALRYFDYNEIFTNLRFQIDLGTYHFSIYKKLIGGQKEDRHLTHKLY GFERIQEFAKQNRPDEWKALVKDLDTYETSNERYISETTPHYHLENQK IGIRFRNGNKEIWPSLKTNGENNEKSKYKLDKPYQAEAFLSVHELLPM MFYYLLLKKEEPNNDKKNASIVEGFIKREIRDMYKLYDAFANGEINNI GDLEKYCEDKGIPKRHLPKQMVAILYDEPKDMVKEAKRKQKEMVKD TKKLLATLEKQTQEEIEDGGRNIRLLKSGEIARWLVNDMMRFQPVQK DNEGNPLNNSKANSTEYQMLQRSLALYNKEEKPTRYFRQVNLINSSN PHPFLKWTKWEECNNILSFYRNYLTKKIEFLNKLKPEDWEKNQYFLK LKEPKTNRETLVQGWKNGFNLPRGIFTEPIREWFKRHQNDSKEYEKV EALKRVGLVTKVIPLFFKEEYFKEDAQKEINNCVQPFYSFPYNVGNIH KPDEKDFLPSEERKKLWGDKDKFKGYKAKVKSKKLTDKEKEEYRS YLEFQSWNKFERELRLVRNQDIVTWLLCTELIDKMKVEGLNVEELQK LRLKDIDTDTAKQEKNNILNRIMPMQLPVTVYEIDDSHNIVKDRPLHT VYIEETKTKLLKQGNFKALVKDRRLNGLFSFVDTSSKAELKDKPISKS VVEYELGEYQNARIETIKDMLLLEKTLIKKYEKLPTDNFSDMLNGWL EGKDESDKARFQNDVKLLVAVRNAFSHNQYPMRNRIAFANINPFSLS SADISEEKKLDIANQLKDKTHKIIKKIIEIEKPIETKE (SEQ ID NO: 127) |

| | | |
|---|---|---|
| A2033_10205 [Bacteroidetes bacterium GWA2_31_9] | OFX18020.1 | MENQTQKGKGIYYYYTKNEDKHYFGSFLNLANNNIEQIIEEFRIRLSL KDEKNIKEIINNYFTDKKSYTDWERGINILKEYLPVIDYLDLAITDKEF EKIDLKQKETAKRKYFRTNFSLLIDTIIDLRNFYTHYFHKPISINPDVAK FLDKNLLNVCLDIKKQKMKTDKTKQALKDGLDKELKKLIELKKAEL KEKKIKTWNITENVEGAVYNDAFNHMVYKNNAGVTILKDYHKSILPD DKIDSELKLNFSISGLVFLLSMFLSKKEIEQFKSNLEGFPKGKVIGENGE YEISKFNNSLKYMATHWIFSYLTFPKGLKQRVKNTFDKETLLMQMIDE LNKVPHEVYQTLSKEQQNEFLEDINEYVQDNEENKKSMENSIVVHPVI RKRYDDKFNYFAIRFLDEFANFPTLKFFVTAGNFVHDKREKQIQGSML TSDRMIKEKINVFGKLTEIAKYKSDYFSNENTLETSEWELFPNPSYLLI QNNIPVHIDLIHNTEEAKQCQIAIDRIKCTTNPAKKRNTRKSKEEIIKIIY QKNKNIKYGDPTALLSSNELPALIYELLVNKKSGKELENIIVEKIVNQY KTIAGFEKGQNLSNSLITKKLKKSEPNEDKINAEKIILAINRELEITENK LNIIKNNRAEFRTGAKRKHIFYSKELGQEATWIAYDLKRFMPEASRKE WKGFHHSELQKFLAFYDRNKNDAKALLNMFWNFDNDQLIGNDLNS AFREFHFDKFYEKYLIKRDEILEGFKSFISNFKDEPKLLKKGIKDIYRVF DKRYYIIKSTNAQKEQLLSKPICLPRGIFDNKPTYIEGVKVESNSALFA DWYQYTYSDKHEFQSFYDMTPRDYKEQFEKFELNNIKSIQNKKNLNKS DKFIYFRYKQDLKIKQIKSQDLFIKLMVDELFNVVFKNNIELNLKKLY QTSDERFKNQLIADVQKNREKGDTSDNKMNENFIWNMTIPLSLCNGQ IEEPKVKLKDIGKFRKLETDDKVIQLLEYDKSKVWKKLEIEDELENMP NSYERIRREKLLKGIQEFEHFLLEKEKFDGINHPKHFEQDLNPNFKTYV INGVLRKNSKLNYTEIDKLLDLEHISIKDIETSAKEIHLAYFLIHVRNKF GHNQLPKLEAFELMKKYYKKNNEETYAEYFHKVSSQIVNEFKNSLEK HS (SEQ ID NO: 128) |
| SAMN05421542_0666 [Chryseobacterium jejuense] | SDI27289.1 | MEKTQTGLGIYYDHTKLQDKYFFGGFFNLAQNNIDNVIKAFIIKFFPER KDKDINIAQFLDICFKDNDADSDFQKKNKFLRIHFPVIGFLISDNDKAG FKKKFALLLKTISELRNFYTHYYHKSIEFPSELFELLDDIFVKTTSEIKK LKKKDDKTQQLLNKNLSEEYDIRYQQQIERLKELKAQGKRVSLTDET AIRNGVFNAAFNHLIYRDGENVKPSRLYQSSYSEPDPAENGISLSQNSI LFLLSMFLERKETEDLKSRVKGFKAKIIKQGEEQISGLKFMATHWVFS YLCFKGIKQKLSTEFHEETLLIQIIDELSKVPDEVYSAFDSKTKEKFLED INEYMKEGNADLSLEDSKVIHPVIRKRYENKFNYFAIRFLDEYLSSTSL KFQVHVGNYVHDRRVKHINGTGFQTERIVKDRIKVFGRLSNISNLKA DYIKEQLELPNDSNGWEIFPNPSYIFIDNNVPIHVLADEATKKGIELFKD KRREKQPEELQKRKGKISKYNIVSMIYKEAKGKDKLRIDEPLALLSLN EIPALLYQILEKGATPKDIELIIKNKLTERFEKIKNYDPETPAPASQLSKR LRNNTTAKGQEALNAEKLSLLIEREIENTETKLSSIEEKRLKAKKEQRR NTPQRSIFSNSDLGRIAAWLADDIKRFMPAEQRKNWKGYQHSQLQQS LAYFEKRPQEAFLLLKEGWDTSDGSSYWNNWVMNSFLENNHFEKFY KNYLMKRVKYFSELAGNIKQHTHNTKFLRKFIKQQMPADLFPKRHYI LKDLETEKNKVLSKPLVFSRGLFDNNPTFIKGVKVTENPELFAEWYSY GYKTEHVFQHFYGWERDYNELLDSELQKGNSFAKNSIYYNRESQLDL IKLKQDLKIKKIKQDLFLKRIAEKLFENVFNYPTTLSLDEFYLTQEERA EKERIALAQSLREEGDNSPNIIKDDFIWSKTIAFRSKQIYEPAIKLKDIG KFNRFVLDDEESKASKLLSYDKNKIWNKEQLERELSIGENSYEVIRRE KLFKEIQNLELQILSNWSWDGINHPREFEMEDQKNTRHPNFKMYLVN GILRKNINLYKEDEDFWLESLKENDFKTLPSEVLETKSEMVQLLFIVIL IRNQFAHNQLPEIQFYNFIRKNYPEIQNNTVAELYLNLIKLAVQKLKDNS (SEQ ID NO: 129) |
| SAMN05444360_11366 [Chryseobacterium carnipullorum] | SHM52812.1 | MNTRVTGMGVSYDHTKKEDKHFFGGFLNLAQDNITAVIKAFCIKFDK NPMSSVQFAESCFTDKDSDTDFQNKVRYVRTHLPVIGYLNYGGDRNT FRQKLSTLLKAVDSLRNFYTHYYHSPLALSTELFELLDTVFASVAVEV KQHKMKDDKTRQLLSKSLAEELDIRYKQQLERLKELKEQGKNIDLRD EAGIRNGVLNAAFNHLIYKEGEIAKPTLSYSSFYYGADSAENGITISQS GLLFLLSMFLGKKEIEDLKSIRIRGFKAKIVRDGEENISGLKFMATHWIF SYLSFKGMKQRLSTDFHEETLLIQIIDELSKVPDEVYHDFDTATREKFV EDINEYIREGNEDFSLGDSTIIHPVIRKRYENKFNYFAVRFLDEHKFPSL RFQVHLGNFVHDRRIKDIHGTGFQTERVVKDRIKVFGKLSEISSIKTEY IEKELDLDSDTGWEIFPNPSYVFIDNNIPIYISTNKTFKNGSSEFIKLRRK EKPEEMKMRGEDKKEKRDIASMIGNAGSLNSKTPLAMLSLNEMPALL YEILVKKTTPEEIELIIKEKLDSHFENIKNYDPEKPLPASQISKRLRNNTT DKGKKVINPEKLIHLINKEIDATEAKFALLAKNRKELKEKFRGKPLRQ TIFSNMELGREATWLADDIKRFMPDILRKNWKGYQHNQLQQSLAFFN SRPKEAFTILQDGWDFADGSSFWNGWIINSFVKNRSFEYFYEAYFEGR KEYFSSLAENIKQHTSNHRNLRRFIDQQMPKGLFENRHYLLENLETEK NKILSKPLVFPRGLFDTKPTFIKGIKVDEQPELFAEWYQYGYSTEHVFQ NFYGWERDYNDLLESELEKDNDFSKNSIHYSRTSQLELIKLKQDLKIK KIKIQDLFLKLIAGHIFENIFKYPASFSLDELYLTQEERLNKEQEALIQS QRKEGDHSDNIIKDNFIGSKTVTYESKQISEPNVKLKDIGKFNRLLDD KVKTLLSYNEDKVWNKNDLDLELSIGENSYEVIRREKLFKKIQNFELQ TLTDWPWNGTDHPEEFGTTDNKGVNHPNFKMYVVNGILRKEITDWF KEGEDNWLENLNETHFKNLSFQELETKSKSIQTAFLIIMIRNQFAHNQL PAVQFFEFIQKKYPEIQGSTTSELYLNFINLAVVELLELLEK (SEQ ID NO: 130) |

-continued

| | | |
|---|---|---|
| SAMN05421786_1011119 [*Chryseobacterium ureilyticum*] | S1S70481.1 | METQILGNGISYDHTKTEDKHFFGGFLNTAQNNIDLLIKAYISKFESSP<br>RKLNSVQFPDVCFKKNDSDADFQHKLQFIRKHLPVIQYLKYGGNREV<br>LKEKFRLLLQAVDSLRNFYTHFYHKPIQLPNELLTLLDTIFGEIGNEVR<br>QNKMKDDKTRHLLKKNLSEELDFRYQEQLERLRKLKSEGKKVDLRD<br>TEAIRNGVLNAAFNHLIFKDAEDFPKPTVSYSSSYYYDSDTAENGISISQS<br>GLLFLLSMFLGRREMEDLKSRVRGFKARIIKHEEQHVSGLKFMATHW<br>VFSEFCFKGIKTRLNADYHEETLLIQLIDELSKVPDELYRSFDVATRER<br>FIEDINEYIRDGKEDKSLIESKIVHPVIRKRYESKFNYFAIRFLDEFVNFP<br>TLRFQVHAGNYVHDRRIKSIEGTGFKTERLVKDRIKVFGKLSTISSLKA<br>EYLAKAVNITDDTGWELLPHPSYVFIDNNIPIHLTVDPSFKNGVKEYQ<br>ERRKLQKPEEMKNRQGGDKMHKPAISSKIGKSKDINPESPVALLSMN<br>EIPALLYEILVKKASPEEVEAKIRQKLTAVFERIRDYDPKVPLPASQVS<br>KRLRNNTDTLSYNKEKLVELANKEVEQTERKLALITKNRRECREKVK<br>GKFKRQKVFKNAELGTEATWLANDIKRFMPEEQKKNWKGYQHSQL<br>QQSLAFFESRPGEARSLLQAGWDFSDGSSFWNGWVMNSFARDNTFD<br>GFYESYLNGRMKYFLRLADNIAQQSSTNKLISNFIKQQMPKGLFDRRL<br>YMLEDLATEKNKILSKPLIFPRGIFDDKPTFKKGVQVSEEPEAFADWY<br>SYGYDVKHKFQEFYAWDRDYEELLREELEKDTAFTKNSIHYSRESQIE<br>LLAKKQDLKVKKVRIQDLYLKLMAEFLFENVFGHELALPLDQFYLTQ<br>EERLKQEQEAIVQSQRPKGDDSPNIVKENFIWSKTIPFKSGRVFEPNVK<br>LKDIGKFRNLLTDEKVDILLSYNNTEIGKQVIENELIIGAGSYEFIRREQ<br>LFKEIQQMKRLSRVRGMGVPIRLNLK (SEQ ID NO: 131) |
| *Prevotella buccae* | WP_004343581 | MQKQDKLFVDRKKNAIFAFPKYITIMENQEKPEPIYYELTDKHFWAAF<br>LNLARHNVYTTINHINRRLEIAELKDDGYMMDIKGSWNEQAKKLDK<br>KVRLRLDLEMKHFPPLEAAAYEITNSKSPNNKEQREKEQSEALSLNNLK<br>NVLFIFLEKLQVLRNYYSHYKYSEESPKPIFETSLLKNMYKVFDANVR<br>LVKRDYMHHENIDMQRDFTHLNRKKQVGRTKNIIDSPNFHYHFADKE<br>GNMTIAGLLEFVSLFDKKDAIWMQKKLKGFKDGRNLREQMTNEVF<br>CRSRISLPKLKLENVQTKDWMQLDMLNELVRCPKSLYERLREKDRES<br>FKVPFDIFSDDYDAEEEPFKNTLVRHQDRFPYFVLRYFDLNEIFEQLRF<br>QIDLGTYHFSIYNKRIGDEDEVRHLTHHLYGFARIQDFAQQNQPEVWR<br>KLVKDLDYFEASQEPYIPKTAPHYHLENEKIGIKFCSTHNNLFPSLKTE<br>KTCNGRSKENLGTQFTAEAFLSVHELLPMMFYYLLLTKDYSRKESAD<br>KVEGIIRKEISNIYAIYDAFANGEINSIADLTCRLQKTNILQGHLPKQMI<br>SILEGRQKDMEKEAERKIGEMIDDTQRRLDLLCKQTNQKIRIGKRNAG<br>LLKSGKIADWLVNDMMRFQPVQKDQNNIPINNSKANSTEYRMLQRA<br>LALFGSENFRLKAYFNQMNLVGNDNPHPFLAETQWEHQTNILSFYRN<br>YLEARKKYLKGLKPQNWKQYQHFLILKVQKTNRNTLVTGWKNSFNL<br>PRGIFTQPIREWFEKHNNSKRIYDQILSFDRVGFVAKAIPLYFAEEYKD<br>NVQPFYDYPFNIGNKLKPQKGQFLDKKERVELWQKNKELFKNYPSEK<br>KKTDLAYLDFLSWKKFERELRLIKNQDIVTWLMFKELFNMATVEGLK<br>IGEIHLRDIDTNTANEESSNNILNRIMPNIKLPVKTYETDNKGNILKERPL<br>ATFYIEETETKVLKQGNFKVLAKDRRLNGLLSFAETTDIDLEKNPITKL<br>SVDHELIKYQTTRISIFEMTLGLEKKLINKYPTLPTDSFRNMLERWLQC<br>KANRPELKNYVNSLIAVRNAFSFINQYPMYDATLFAEVKKFTLFPSVD<br>TKKIELNIAPQLLEIVGKAIKEIEKSENKN (SEQ ID NO: 132) |
| *Porphyromonas gingivalis* | WP_005873511 | MNTVPASENKGQSRTVEDDPQYFGLYLNLARENLIEVESHVRIKFGK<br>KKLNEESLKQSLLCDHLLSVDRWTKVYGHSRRYLPFLHYFDPDSQIE<br>KDHDSKTGVDPDSAQRLIRELYSLLDFLRNDFSHNRLDGTTFEHLEVS<br>PDISSFITGTYSLACGRAQSRFADFFKPDDFVLAKNRKEQLISVADGKE<br>CLTVSGLAFFICLFLDREQASGMLSRIRGFKRTDENWARAVHETFCDL<br>CIRHPHDRLESSNTKEALLLDMLNELNRCPRILYDMLPEEERAQFLPA<br>LDENSMNNLSENSLNEESRLLWDGSSDWAEALTKRIRHQDRFPYLML<br>RFIEEMDLLKGIRFRVDLGEIELDSYSKKVGRNGEYDRTITDHALAFG<br>KLSDFQNEEEVSRMISGEASYPVRFSLFAPRYAIYDNKIGYCHTSDPVY<br>PKSKTGEKRALSNPQSMGFISVHNLRKLLLMELLCEGSFSRMQSDFLR<br>KANRILDETAEGKLQFSALFPEMRHRFIPPQNPKSKDRREKAETTLEK<br>YKQEIKGRKDKLNSQLLSAFDMNQRQLPSRLLDEWMNIRPASHSVKL<br>RTYVKQLNEDCRLRLRKFRKDGDGKARAIPLVGEMATFLSQDIVRMII<br>SEETKKILTSAYYNEMQRSLAQYAGEENRRQFRAIVAELHLLDPSSGH<br>PFLSATMETAHRYTEDFYKCYLEKKREWLNKTFYRPEQDENTKRRIS<br>VPFFVPDGEARKLLPLLIRRRMKEQNDLQDWIRNKQAHPIDLPSHLFDS<br>KIMELLKVKDGKKKWNEAFKDWWSTKYPDGMQPFYGLRRELNIHG<br>KSVSYIPSDGKKFADCYTHLMEKTVQDKKRELRTAGKPVPPDLAADI<br>KRSFHRAVNEREFMLRLVQEDDRLMLMAINKMMTDREEDILPGLKNI<br>DSILDEENQFSLAVHAKVLEKEGEGGDNSLSLVPATIEIKSKRKDWSK<br>YIRYRYDRRVPGLMSHFPEHKATLDEVKTLLGEYDRCRIKIFDWAFAL<br>EGAIMSDRDLKPYLHESSSREGKSGEHSTLVKMLVEKKGCLTPDESQ<br>YLILIRNKAAHNQFPCAAEMPLIYRDVSAKVGSIEGSSAKDLPEGSSLV<br>DSLWKKYEMIIRKILPILDPENRFFGKLLNNMSQPINDL<br>(SEQ ID NO: 133) |
| *Porphyromonas gingivalis* | WP_005874195 | MTEQNEKPYNGTYYTLEDKHFWAAFFNLARHNAYITLAHIDRQLAYS<br>KADITNDEDILFFKGQWKNLDNDLERKARLRSLILKHFSFLEGAAYGK<br>KLFESQSSGNKSSKKKELTKKEKEELQANALSLDNLKSILFDFLQKLK<br>DFRNYYSHYRHPESSELPLFDGNMLQRLYNVFDVSVQRVKRDHEHN<br>DKVDPHRHFNHLVRKGKKDKYGNNDNPFFKHHFVDREEKVTEAGLL<br>FFVSLFLEKRDAIWMQKKIRGFKGGTEAYQQMTNEVFCRSIUSLPKLK |

|  |  | LESLRTDDWMLLDMLNELVRCPKSLYDIZ.LREEDRARFRVPVDILSDE<br>DDTDGTEEDPFKNTLVRHQDRFPYFALRYFDLKKVFTSLRFHIDLGTY<br>HFAIYKKNIGEQPEDRHLTRNLYGFGRIQDFAEEHRPEEWKRLVRDLD<br>YFETGDKPYITQTTPHYHIEKGKLGLRFVPEGQLLWPSPEVGATRTGRS<br>KYAQDKRFTAEAFLSVHELMPMMFYYFLLREKYSEEASAEKVQGRIK<br>RVIEDVYAVYDAFARDEINTRDELDACLADKGIRRGHLPRQMIAILSQ<br>EHKDMEEKVRKKLQEMIADTDHRLDMLDRQTDRKIRIGRKNAGLPK<br>SGVIADWLVRDMMRFQPVAKDTSGKPLNNSKANSTEYRMLQRALAL<br>FGGEKERLTPYFRQMNLTGGNNPHPFLHETRWESHTNILSFYRSYLKA<br>RKAFLQSIGRSDREENHRFLLLKEPKTDRQTLVAGWKSEFHLPRGIFT<br>EAVRDCLIEMGYDEVGSYKEVGFMAKAVPLYFERACKDRVQPFYDY<br>PFNVGNSLKPKKGRFLSKEKRAEEWESGKERFRDLEAWSHSAARRIE<br>DAFVGIEYASWENKKKIEQLLQDLSLWETFESKLKVKADKINIAKLKK<br>EILEAKEHPYHDFKSWQKFERELRLVKNQDIITWMMCRDLMEENKVE<br>GLDTGTLYLKDIRTDVQEQGSLNVLNHVKPMRLPVVVYRADSRGHV<br>HKEEAPLATVYIEERDTKLLKQGNFKSFVKDRRLNGLFSFVDTGALA<br>MEQYPISKLRVEYELAKYQTARVCAFEQTLELEESLLTRYPHLPDESF<br>REMLESWSDPLLDKWPDLQREVRLLIAVRNAFSHNQYPMYDETIFSSI<br>RKYDPSSLDAIEERMGLNIAHRLSEEVKLAKEMVERIIQA (SEQ ID<br>NO: 134) |
| Prevotella<br>pallens | WP_006044833 | MKEEEKGKTPVVSTYNKDDKHFWAAFLNLARHNVYITVNHINKILGE<br>GEININRDGYENTLEKSWNEIKDINKKDRLSKLIIKHFPPFLEVTTYQRNSA<br>DTTKQKEEKQAEAQSLESLKKSFFVFIYKLRDLRNHYSHYKHSKSLER<br>PKFEEDLQEKMYNIFDASIQLVKEDYKHNTDIKTEEDFKHLDRKGQFK<br>YSFPADNEGNITESGLLFFVSLFLEKKDAIWVQKKLEGFKCSNESYQKM<br>TNEVFCRSRMLLPKLRLQSTQTQDWILLDMLNELIRCPKSLYERLREE<br>DRKKFRVPIEIADEDYDAEQEPFKNALVRHQDRFPYFALRYFDYNEIF<br>TNLRFQIDLGTYHFSIYKKQIGDYKESHHLTHKLYGFERIQEFTKQNRP<br>DEWRKFVKTFNSFETSKEPYIPETTPHYHLENQKIGIRFRNDNDKIWPS<br>LKTNSEKNEKSKYKLDKSFQAEAFLSVHELLPMMFYYLLLKTENTDN<br>DNEIEFKKKENKNDKQEKHKIEEIIENKITEIYALYDAFANGKINSIDKL<br>EEYCKGKDIEIGHLPKQMIAILKSEHKDMATEAKRKQEEMLADVQKS<br>LESLDNQINEEIENVERKNSSLKSGEIASWLVNDMMRFQPVQKDNEG<br>NPLNNSKANSTEYQMLQRSLALYNKEEKPTRYFRQVNLIESSNPHPFL<br>NNTEWEKCNNILSFYRSYLEAKKNFLESLKPEDWEKNQYFLMLKEPK<br>TNCETLVQGWKNGFNLPRGIFTEPIRKWFMEHRKNITVAELKRVGLV<br>AKVIPLFFSEEYKDSVQPFYNYLFNVGNINKPDEKNFLNCEERRELLR<br>KKKDEFKKMTDKEKEENPSYLEFQSWNKFERELRLVRNQDIVTWLLC<br>MELFNKKKIKELNVEKIYLKNINTNTTKKEKNTEEKNGEEKIIKEKNNI<br>LNIRIMPIMRLPIKVYGRENFSKNKKKKIRRNTFFTVYIEEKGTKLLKQG<br>NFKALERDRRLGGLFSFVKTHSKAESKSNTISKSRVEYELGEYQKARI<br>EIIKDMLALEETLIDKYNSLDTDNFHNMLMTGWLKLKDEPDKASFQND<br>VDLLIAVRNAFSHNQYPMRNRIAFANINPFSLSSANTSEEKGLGIANQL<br>KDKTHKTIEKHEIEKPIETKE (SEQ ID NO: 135) |
| Myroides odoratimimus | WP_006261414 | MKDILTTDTTEKQNRFYSHKIADKYFFGGYFNLASNNIYEVFEEVNKR<br>NTFGKLAKRDNGNLKNYIIHVEKDELSISDFEKRVAIFASYFPILETVD<br>KKSIKERNRTIDLTLSQRIRQFREMLISLVTAVDQLRNFYTHYHHSEIVI<br>ENKVLDFLNSSEVSTALHVKDKYLKTDKTKEFLKETIAAELDILIEAY<br>KKKQIEKKNTRFKANKREDILNAIYNEAFWSFINDKDKDKETVVAKG<br>ADAYFEKNHHKSNDPDFALNISEKGIVYLLSFELTNKEMDSLKANLTG<br>FKGKVDRESGNSIKYMATQRIYSFHTYRGLKQKIRTSEEGVKETLLMQ<br>MIDELSKVPNVVYQHLSTTQQNSFIEDWNEYYKDYEDDVETDDLSRV<br>IHPVIRKRYEDRENYFAIRFLDEFFDFPTLRFQVHLGDYVHDRRTKQL<br>GKVESDRIIKEKVTVFARLKDINSAKANYFHSLEEQDKEELDNKWTLF<br>PNPSYDFPKEHTLQHQGEQKNAGKIGIYVKLRDTQYKEKAALEEARK<br>SLNPKERSATKASKYDIITQIIEANDNVKSEKPLNFTGQPIAYLSMNDIH<br>SMLFSLLTDNAELKKTPEEVEAKLIDQIGKQINEILSKDTDTKILKKYK<br>DNDLKETDTKITRDLARDKEEIEKLILEQKQRADDYNYTSSTKFNID<br>KSRKRKHLLFNAEKGKIGVWLANDIKRFMTEEFKSKWKGYQHTELQ<br>KLFAYYDTSKSDLDLILSDMVIMVKDYPIELIALVKKSRTLVDFLNKYL<br>EARLGYMENVITRVKNSIGTPQEKTVRKECFTELKKSNYTVVSLDKQ<br>VERILSMPLFIERGFMDDKPTMLEGKSYQQHKEKFADWFVHYKENSN<br>YQNFYDTEVYEITTEDKREKAKVTKKIKQQQKNDVFTLMMVNYMLE<br>EVLKLSSNDRLSLNELYQTKEERIVNKQVAKDTQERNKNYIWNKVVD<br>LQLCEGLVRIDKVKLKDIGNFRKYENDSRVKEFLTYQSDIVWSAYLSN<br>EVDSNKLYVIERQLDNYESIRSKELLKEVQEIECSVYNQVANKESLKQ<br>SGNENFKQYVLQGLVPIGMDVREMLILSTDVKFIKEEIIQLGQAGEVE<br>QDLYSLIYIRNKFAHNQLPIKEFFDFCENNYRSISDNEYYAEYYMEIFR<br>SIKEKYTS (SEQ ID NO: 136) |
| Myroides odoratimimus | WP_006265509 | MKDILTTDTTEKQNRFYSHKIADKYFFGGYFNLASNNIYEVFEEVNKR<br>NTFGKLAKRDNGNLKNYIHVFKDELSISDFEKRVAIFASYFPILETVD<br>KKSIKERNRTIDLTLSQRIRQFREMLISLVTAVDQLRNFYTHYHHSEIVI<br>ENKVLDFLNSSLVSTALHVKDKYLKTDKTKEFLKETIAAELDILIEAY<br>KKKQIEKKNTRFKANKREDILNAIYNEAFWSFINDKDKDKETVVAKG<br>ADAYFEKNHHKSNDPDFALNISEKGIVYLLSFFLTNKEMDSLKANLTG<br>FKGKVDRESGNSIKYMATQRIYSFHTYRGLKQKIRTSEEGVKETLLMQ |

| | | |
|---|---|---|
| | | MIDELSKVPNVVYQHLSTTQQNSFIEDWNEYYKDYEDDVETDDLSRV<br>IHPVIRKRYEDRFNYFAIRFLDEFFDFPTLRFQVHLGDYVHDRRTKQL<br>GKVESDRIIKEKVTVFARLKDINSAKASYFHSLEEQDKEELDNKWTLF<br>PNPSYDFPKEHTLQHQGEQKNAGKIGIYVKLRDTQYKEKAALEEARK<br>SLNPKERSATKASKYDIITQIIEANDNVKSEKPLVFTGQPIAYLSMNDIH<br>SMLFSLLTDNAELKKTPEEVEAKLIDQIGKQINEILSKDTDTKILKKYK<br>DNDLKETDTDKITRDLARDKEEIEKLILEQKQRADDYNYTSSTKFNID<br>KSRRKHLLFNAEKGKIGVWLANDIKRFMFKESKSKWKGYQHTELQ<br>KLFAYFDTSKSDLELILSDMVMVKDYPIELIDLVRKSRTLVDFLNKYL<br>EARLGYIENVRTRVKNSIGTPQFKTVRKECFAFLKESNYWASLDKQIE<br>RILSMPLFIERGFMDSKPTMLEGKSYQQFIKEDFADWFVWKENSNYQ<br>NFYDTEVYEIITEDKREQAKVTKKIKQQQKNDVFTLMMVNYMLEEV<br>LKLPSNDRLSLNELYQTKEERIVNKQVAKDTQERNKNYIWNKVVDLQ<br>LCEGLVRIDKVKLKDIGNFRKYENDSRVKEFLTYQSDIVWSGYLSNEV<br>DSNKLYVIERQLDNYESIRSKELLKEVQEIECIVYNQVANKESLKQSG<br>NENFKQYVLQGLLPRGTDVREMLILSTDVKFKKEEIMQLGQVREVEQ<br>DLYSLIYIRNKFAHNQLPIKEFFDFCENNYRPISDNEYYAEYYMEIFRSI<br>KEKYAS (SEQ ID NO: 137) |
| Prevotella<br>sp. MSX73 | WP_007412163 | MQKQDKLFVDRKKNAIFAFPKYITIMENQEKPEPRYYELTDKHFWAAF<br>LNLARHNVYTTINHINRRLEIAELKDDGYMMGIKGSWNEQAKKLDK<br>KVRLRDLMKHFPPFLEAAAYERRNSKSPNNKEQREKEQSEALSLNNLK<br>NYLFIFLEKLQVLRNYYSHYKYSEESPKPIFETSLLKNMYKVFDANVR<br>LVKRDYMHHENIDMQRDFTHLNRKKQVGRTKNIIDSPNFFSYHFADKE<br>GNMTIAGLLFFVSLFLDKKDARVMQKKLKGFKDGRNLREQMTNEVF<br>CRSRISLPKLKLENVQTKDWTVIQLDMLNELVRCPKSLYERLREKDRES<br>FKVPFDIFSDDYDAFFFPFKNTLVRHQDRFPYFVLRYFDLNEIFEQLRF<br>QIDLGTYHFSIYNKRIGDEDEVRHLTHHLYGFARIQDFAPQNQPEEWR<br>KLVKDLDHFETSQEPYISKTAPHYHLENEKIGIKFCSTHNNLFPSLKRE<br>KTCNGRSKFNLGTQFTAEAFLSVHELLPMMFYYLLLTKDYSRKESAD<br>KVEGIIRKEISNIYAIYDAFANNEINSIADLTCRLQKTNILQGHLPKQMI<br>SILEGRQKDMEKEAERKIGEMIDDTQRRLDLLCKQTNQKIRIGKRNAG<br>LLKSGKQIADWLVSDMMRFQPVQKDTNNAPINNSKANSTEYRMLQHA<br>LALFGSESSRLKAYFRQMNLVGNANPHPFLAETQWEHQTNILSFYRN<br>YLEARKKYLGLKPQNWKQYHFLILKVQKTNRNTLVTGWKNSFNL<br>PRGIFTQPIREWFEKHNNSKRIYDQILSFDRVGFVAKAIPLYFAEEYKD<br>NVQPFYDYPFNIGNKLKPQKGQFLDKKERVELWQKNKELFKNYPSEK<br>NKTDLAYLDFLSWKKFERELRLIKNQDRVLWLMFKELFKLTRVEGLKI<br>GEIHLRDIDTNTANEESNNILNRIMPMKLPVKTYETDNKGNILKERPLA<br>TFYIEETETKVLKQGNFKVLAKDRRLNGLLSFAETTDIDLEKNPITKLS<br>VDYELIKYQTTRISIFEMTLGLEKKLIDKYSTLPTDSFRNMLERWLQCK<br>ANRPELKNYVNSLIAVRNAFSHNQYPMYDATLFAEVKKFTLFPSVDT<br>KKIELNIAPQLLEIVGKAIKEIEKSENKN (SEQ ID NO: 138) |
| Porphyromonas<br>gingivalis | WP_012458414 | MTEQNERPYNGTYYTLEDKHFWAAFFNLARFINAYITLAHIDRQLAYS<br>KADITNDEDILFFKGQWKNLDNDLERKARLRSLILKFIFSFLEGAAYGK<br>KLFESQSSGNKSSKKKELTKKEKEELQANALSLDNLKSILFDFLQKLK<br>DFRNYYSHYRHPESSELPLFDGNMLQRLYNVFDVSVQRVKRDHEHN<br>DKVDPHRHFNHLVRKGKKDRYGNNDNPFFKTHHFVDREEKVTEAGLL<br>FFVSLFLEKRDAIWMQKKIRGFKGGTETYQQMTNEVFCRSRISLPKLK<br>LESLRTDDWMLLDMLNELVRCPKSLYDRLREEDRARFRVPVDILSDE<br>DDTDGTEEDPFKNTLVRHQDRFPYFALRYFDLKKVFTSLRFHIDLGIY<br>HFARYKKNIGEQPEDRHLTRNLYGFGRIQDFAEEHRPEEWKRLVRDLD<br>YFETGDKPYRRQTTPFFYHIEKGKLGLRFVPEGQHLWPSPEVGATRTGR<br>SKYAQDKRLTAEAFLSVHELMPMMFYYFLLREKYSDEASAERVQGRI<br>KRVIEDVYAVYDAFARGEINTRDELDACLADKGIRRGHLPRQMIGILS<br>QEHKDMEEKVRKKLQEMPVDTDHRLDMLDRQTDRKIRIGRKNAGLP<br>KSGVIADWLVRDMMRFQPVAKDTSGKPLNNSKANSTEYRMLQRALA<br>LFGGEKERLTPYFRQMNLTGGNNPHPFLHETRWESHTNILSFYRSYLK<br>ARKAFLQSIGRSDRVENHRFLLLKEPKTDRQTLVAGWKGEFHLPRGIF<br>TEAVRDCLIEMGLDEVGSYKEVGFMAKAVPLYFERACKDRVQPFYD<br>YPFNVGNSLKPKKGRFLSKEKRAEEWESGKERFRLAKLKKEILEAKE<br>HPYLDFKSWRQKFERELRLVKNQDIITWMICRDLMEENKVEGLDTGTL<br>YLKDIRTDVQEQGNLNVLNRVKPMRLPVVVYRADSRGHVHKEQAPL<br>ATVYLEERDTKLLKQGNFKSFVKDRRLNGLFSFVDTGALAMEQYPISK<br>LRVEYELAKYQTARVCAFEQTLELEESLLTRYPHLPDKNFRKMLESW<br>SDPLLDKWPDLHGNVRLLIAVRNAFSHNQYPMYDEAVFSSIRKYDPS<br>SPDAIEERMGLNIAHRLSEEVKQAKEMAERIIQA (SEQ ID NO: 139) |
| Paludibacter<br>propionicigenes | WP_013446107 | MKTSANNIYFNGINSFKKIFDSKGAIAPIAEKSCRNFDIKAQNDVNKEQ<br>RIHYFAVGHTFKQLDTENLFEYVLDENLRAKRPTRFISLQQFDKEFIEN<br>IKRLISDIRNINSHYIHRFDPLKIDAVPTNIIDFLKESFELAVIQIYLKEKG<br>INYLQFSENPHADQKLVAFLHDKFLPLDEKKTSMLQNETPQLKEYKE<br>YRKYFKTLSKQAAIDQLLFAEKETDYIWNLFDSHPVLTISAGKYLSFY<br>SCLFLLSMFLYKSEANQLISKIKGFKKNTTEEEKSKREIFTFFSKRFNSM<br>DIDDSEENQLVKFRDLILYLNHYPVAWNKDLELDSSNPAMTDKLKSKII<br>ELEINRSFPLYEGNERFATFAKYQIWGKKHLGKSIEKEYINASFTDEEIT<br>AYTYETDTCPELKDAFIKKLADLKAAKGLFGKRKEKNESDIKKTETSI<br>RELQHEPNPIKDKLIQRIEKNLLTVSYGRNQDRFMDFSARFLAEINYFG |

|   |   | QDASFKMYHFYATDEQNSELEKYELPKDKKKYDSLKFHQGKLVHFIS |
|---|---|---|

```
                                    QDASFKMYHFYATDEQNSELEKYELPKDKKKYDSLKFHQGKLVHFIS
                                    YKEHLKRYESWDDAFVIENNAIQLKLSFDGVENTVTIQRALLIYLLED
                                    ALRNIQNNTAENAGKQLLQEYYSHNKADLSAFKQILTQQDSIEPQQKT
                                    EFKKLLPRRLLNNYSPAINHLQTPHSSLPLILEKALLAEKRYCSLVVKA
                                    KAEGNYDDFTKRNKGKQFKLQFIRKAWNLMYFRNSYLQNVQAAGHH
                                    KSFHIERDEFNDFSRYMFAFEELSQYKYYLNEMFEKKGFFENNEFKIL
                                    FQSGTSLENLYEKTKQKFEIWLASNTAKTNKPDNYHLNNYEQQFSNQ
                                    LFFINLSHFINYLKSTGKLQTDANGQIIYEALNNVQYLIPEYYYTDKPE
                                    RSESKSGNKLYNKLKATKLEDALLYEMAMCYLKADKQIADKAKHPI
                                    TKLLTSDVEFNITNKEGIQLYHLLVPFKKIDAFIGLKMFIKEQQDKKHP
                                    TSFLANIVNYLELVKNDKDIRKTYEAFSTNPVKRTLTYDDLAKIDGHL
                                    ISKSIKFTNVTLELERYFIFKESLIVKKGNNIDFKYIKGLRNYYNNEKKK
                                    NEGIRNKAFHFGIPDSKSYDQLIRDAEVMFIANEVKPTHATKYTDLNK
                                    QLHTVCDKLMETVHNDYFSKEGDGKKKREAAGQKYFENIISAK
                                    (SEQ ID NO: 140)

Porphyromonas      WP_013816155     MTEQNEKPYNGTYYTLEDKHFWAAFFNLARHNAYITLAHIDRQLAYS
gingivalis                          KADITNDEDILFFKGQWKNLDNDLERKARLRSLILKHFSFLEGAAYGK
                                    KLFESQSSGNKSSKNKELTKKEKEELQANALSLDNLKSILFDFLQKLK
                                    DFRNYYSHYRHPESSELPLFDGNMLQRLYNVFDVSVQRVKRDHEHN
                                    DKVDPHRHFNHLVRKGKKDRYGNNDNPFFKHHFVDREGTVTEAGLL
                                    FFVSLFLEKRDAIWMQKKIRGFKGGTETYQQMTNEVFCRSRISLPKLK
                                    LESLRTDDWMLLDMLNELVRCPKSLYDRLREEDRARFRVPVDILSDE
                                    EDTDGAEEDPFKNTLVRHQDRFPYFALRYFDLKKVFTSLRFQIDLGTY
                                    HFAIYKKNIGEQPEDRHLTRNLYGFGRIQDFAEEHRPEEWKRLVRDLD
                                    YFETGDKPYITQTTPHYHIEKGKIGLRFVPEGQHLWPSPEVGATRTGR
                                    SKYAQDKRFTAEAFLSAHELMPMMFYYFLLREKYSEEASAERVQGRI
                                    KRVIEDVYAVYDAFARDEINTRDELDACLADKGIRRGHLPRQMIGILS
                                    QEHKDMEEKIRKKLQEMMADTDHRLDMLDRQTDRKIRIGRKNAGLP
                                    KSGVIADWLVRDMMRFQPVAKDTSGKPLNNSKANSTEYRMLQRALA
                                    LFGGEKERLTPYFRQMNLTGGNNPHPFLHETRWESHTNILSFYRSYLK
                                    ARKAFLQSIGRSDRVENHRFLLLKEPKTDRQTLVAGWKGEFHLPRGIF
                                    TEAVRDCLIEMGLDEVGSYKEVGFMAKAVPLYFERACKDWVQPFYN
                                    YPFNVGNSLKPKKGRFLSKEKRAEEWESGKERFRLAKLKKEILEAKE
                                    HPYLDFKSWQKFERELRLVKNQDIITWMICGDLMEENKVEGLDTGTL
                                    YLKDIRTDVQEQGSLNVLNRVKPMRLPVVVYRADSRGHVHKEQAPL
                                    ATVYIEERDTKLLKQGNFKSFVKDRRLNGLFSFVDTGALAMEQYPISK
                                    LRVEYELAKYQTARVCAFEQTLELEESLLTRCPHLPDKNFRKMLESW
                                    SDPLLDKWPDLHRKVRLLIAVRNAFSHNQYPMYDEAVFSSIRKYDPSF
                                    PDAIEERMGLNIAHRLSEEVKQAKETVERIIQA (SEQ ID NO: 141)

Flavobacterium     WP_014165541     MSSKNESYNKQKTFNHYKQEDKYFFGGFLNNADDNLRQVGKEFKTR
columnare                           INFNHNNNELASVFKDYFNKEKSVAKREHALNLLSNYFPVLERIQKHT
                                    NHNPEQTREIFELLLDTIKKLRDYYTHHYHKPITINPKIYDFLDDTLLD
                                    VLITIKKKKVKNDTSRELLKEKLRPELTQLKNQKREELIKKGKKLLEE
                                    NLENAVFNHCLRPFLEENKTDDKQNKTVSLRKYRKSKPNEETSITLTQ
                                    SGLVFLMSFFLHRKEFQVFTSGLEGFKAKVNTIKEEEISLNKNNIVYMI
                                    THWSYSYYNFKGLKHRIKTDQGVSTLEQNNTTHSLTNTNTKEALLTQ
                                    IVDYLSKVPNEIYETLSEKQQKEFEEDINEYMRENPENEDSTFSSIVSH
                                    KVIRKRYENKFNYFAMRFLDEYAELPTLRFMVNFGDYIKDRQKKILES
                                    IQFDSERIIKKEIHLFEKLSLVTEYKKNVYLKETSNIDLSRFPLFPNPSYV
                                    MANNNIPFYIDSRSNNLDEYLNQKKKAQSQNKKRNLTFEKYNKEQSK
                                    DAIIAMLQKEIGVKDLQQRSTIGLLSCNELPSMLYEVIVKDIKGAELEN
                                    KIAQKIREQYQSIRDFTLDSPQKDNIPTTLIKTINTDSSVTFENQPIDIPRL
                                    KNAIQKELTLTQEKLLNVKEHEIEVDNYNRNKNTYKFKNQPKNKVD
                                    DKKLQRKYVFYRNEIRQEANWLASDLIHFMKNKSLWKGYMHNELQS
                                    FLAFFEDKKNDCIALLETVFNLKEDCILTKGLKNLFLKHGNFIDFYKEY
                                    LKLKEDFLNTESTFLENGLIGLPPKILKKELSKRFKYIFIVFQKRQFIIKE
                                    LEEKKNNLYADAINLSRGIFDEKPTMIPFKKPNPDEFASWFVASYQYN
                                    NYQSFYELTPDIVERDKKKKYKNLRAINKVKIQDYYLKLMVDTLYQD
                                    LFNQPLDKSLSDFYVSKAEREKIKADAKAYQKRNDSSLWNKVIHSL
                                    QNNRITANPKLKDIGKYKRALQDEKIATLLTYDDRTWTYALQKPEKE
                                    NENDYKELHYTALNMELQEYEKVRSKELLKQVQELEKQILEEYTDFL
                                    STQIHPADFEREGNPNFKKYLAHSILENEDDLDKLPEKVEAMRELDET
                                    ITNPIIKKAIVLIIIRNKMAFINQYPPKFIYDLANRFVPKKEEEYFATYFN
                                    RVFETITKELWENKEKKDKTQV (SEQ ID NO: 142)

Psychroflexus      WP_015024765     MESIIGLGLSFNPYKTADKHYFGSFLNLVENNLNAVPAEFKERISYKA
torquis                             KDENISSLIEKHFIDNMSIVDYEKKISILNGYLPIIDFLDDELENNLNTRV
                                    KNFKKNFIILAEAIEKLRDYYTHFYHDPITFEDNKEPLLELLDEVLLKTI
                                    LDVKKKYLKTDKTKEILKDSLREEMDLLVIRKTDELREKKKTNPKIQH
                                    TDSSQIKNSIFNDAFQGLLYEDKGNNKKTQVSHRAKTRLNPKDIHKQE
                                    ERDPFEIPLSTSGLVFLMSLFLSKKEIEDFKSNIKGFKGKVVKDENHNSL
                                    KYMATHRVYSILAFKGLKYRIKTDTFSKETLMMQMIDELSKVPDCVY
                                    QNLSETKQKDFIEDWNEYFKDNEENTENLENSRVVHPVIRKRYEDKF
                                    NYFAIRFLDEFANPKTLKFQVFMGYYIHDQRTKTIGTTNITTERTVKEK
                                    INVFGKLSKMDNLKKHFFSQLSDDENTDWEFFPNPSYNFLTQADNSP
                                    ANNIPIYLELKNQQIIKEKDAIKAEVNQTQNRNPNKPSKRDLLNKILKT
                                    YEDFHQGDPTAILSLNEIPALLHLFLVKPNNKTGQQIENIIRIKIEKQFK
```

|   |   |   |
|---|---|---|
|   |   | AINHPSKNNKGIPKSLFADTNVRVNAIKLKKDLEAELDMLNKKHIAFK<br>ENQKASSNYDKLLKEHQFTPKNKRPELRKYVFYKSEKGEEATWLAN<br>DIKRFMPKDFKTKWKGCQHSELQRKLAFYDRHTKQDIKELLSGCEFD<br>HSLLDINAYFQKDNFEDFFSKYLENRIETLEGVLKKLHDFKNEPTPLK<br>GVFKNCFKFLKRQNYVTESPEIIKKRTLAKPTFLPRGVFDERPTMKKG<br>KNPLKDKNEFAEWFVEYLENKDYQKFYNAEEYRMRDADFKKNAVIK<br>KQKLKDFYTLQMVNYLLKEVFGKDEMNLQLSELFQTRQERLKLQGI<br>AKKQMNKETGDSSENTRNQTYIWRNKDVPVSFFNGKVTIDKVLKNIG<br>KYKRYEIIDERVKTFIGYEVDEKWMMYLPHNVVKDRYSVKPINVIDLQ<br>IQEYEEIRSHELLKEIQNLEQYIYDHTTDKNILLQDGNPNFKMYVLNGL<br>LIGIKQVNIPDFIVLKQNTNFDKIDFTGIASCSELEKKTIILIAIRNKFAHN<br>QLPNKMIYDLANEFLKIEKNETYANYYLKVLKKMISDLA<br>(SEQ ID NO: 143) |
| Riemerella<br>anatipestifer | WP_015345620 | MFFSFHNAQRVIFKHLYKAFDASLRMVKEDYKAHFTVNLTRDFAHL<br>NRKGKNKQDNPDFNRYRFEKDGFFTESGLLFFTNLFLDKRDAYWML<br>KKVSGFKASHKQREKMTTEVFCRSRILLPKLRLESRYDHNQMLLDML<br>SELSRCPKLLYEKLSEENKKHFQVEADGFLDEIEEEQNPFKDTLIRHQD<br>RFPYFALRYLDLNESFKSIRFQVDLGTYHYCIYDKKIGDEQEKRHLTR<br>TLLSFGRLQDFTEINRPQEWKALTKDLDYKETSNQPFISKTTPHYHITD<br>NKIGFRLGTSKELYPSLEIKDGANRIAKYPYNSGFVAHAFISVHELLPL<br>MFYQHLTGKSEDLLKETVRHIQRIYKDFEEERINTIEDLEKANQGRLPL<br>GAFPKQMLGLLQNKQPDLSEKAKIKIEKLIAETKLLSHRLNTKLKSSP<br>KLGKRREKLIKTGVLADWLVKDFMRFQPVAYDAQNQPIKSSKANSTE<br>FWFIRRALALYGGEKNRLEGYFKQTNLIGNTNPHPFLNKFNWKACRN<br>LVDFYQQYLEQREKFLEAIKHQPWEPYQYCLLLKVPKENRKNLVKG<br>WEQGGISLPRGLFTEAIRETLSKDLTLSKPIRKEIKKFSGRVGFISRAITL<br>YFKEKYQDKHQSFYNLSYKLEAKAPLLKKEEHYEYWQQNKPQSPTE<br>SQRLEMTSDRWKDYLLYKRWQHLEKKLRLYRNQDIMLWLMTLELT<br>KNHFKELNLNYHQLKLENLAVNVQEADAKLNPLNQTLPMVLPVKVY<br>PTTAFGEVQYHETPIRTVYIREEQTKALKMGNFKALVKDRRLNGLFSF<br>IKEENDTQKHPISQLRLRRELEIYQSLRVDAFKETLSLEEKLLNKHASL<br>SSLENEFRTLLEEWKKKYAASSMVTDKHIAFIASVRNAFCHNQYPFY<br>KETLHAPILLFTVAQPTTEEKDGLGIAEALLKVLREYCEIVKSQI<br>(SEQ ID NO: 144) |
| Prevotella<br>pleuritidis | WP_021584635 | MENDKRLEESACYTLNDKHFWAAFLNLARHNVYITVNHINKTLELK<br>NKKNQEIIIDNDQDILAIKTHWAKVNGDLNKTDRLRELMIKFSPFFLEA<br>AIYSNNKEDKEEVKEEKQAKAQSFKSLKDCLFLFLEKLQEARNYYSH<br>YKYSESSKEPEFEEGLLEKMYNTFDASIRLVKEDYQYNKDIDPEKDFK<br>HLERKEDFNYLFTDKDNKGKITKNGLLFFVSLFLEKKDAIWMQQKFR<br>GFKDNRGNKEKMTHEVFCRSRMLLPKIRLESTQTQDWILLDMLNELI<br>RCPKSLYERLQGAYREKFKVPFDSIDEDYDAEQEPFRNTLVRHQDRFP<br>YFALRYFDYNEIFKNLRFQIDLGTYHFSIYKKLTGGKKEDRHLTHKLY<br>GFERIQEFTKQNRPDKWQAIIKDLDTYETSNERYISETTPHYHLENQKI<br>GIRFRNDNNDIWPSLKTNGEKNEKSKYNLDKPYQAEAFLSVHELLPM<br>MFYYLLLKMENTDNDKEDNEVGTKKKGNKNNKQEKHKIEEIIENKIK<br>DIYALYDAFTNGEINSDELAEQREGKDIEIGHLPKQLIVILKNKSKDM<br>AEKANRKQKEMIKDTKKRLATLDKQVKGEIEDGGRNIRLLKSGEIAR<br>WLVNDMMRFQPVQKDNEGKPLNNSKANSTEYQMLQRSLALYNKEE<br>KPTRYFRQVNLIKSSNPHPFLEDTKWEECYNILSFYRNYLKAKIKFLN<br>KLKPEDWKKNQYFLMLKEPKTNRKTLVQGWKNGFNLPRGIFTEPIKE<br>WFKRHQNDSEEYKKVEALDRVGLVAKVIPLFFKEEYFKEDAQKEINN<br>CVQPFYSFPYNVGNIHKPEEKNFLHCEERRKLWDKKKDKFKGYKAK<br>EKSKKMTDKEKEEHRSYLEFQSWNKFERELRLVRNQDILTWLLCTKL<br>IDKLKIDELNIEELQKLRLKDIDTDTAKKEKNNILNRVMPMRLPVTVY<br>EIDKSFNIVKDKPLHTVYIEETGTKLLKQGNFKALVKDRRLNGLFSFV<br>KTSSEAESKSKPISKLRVEYELGAYQKARIDIIKDMLALEKTLIDNDEN<br>LPTNKFSDMLKSWLKGKGEANKARLQNDVGLLVAVRNAFSHNQYP<br>MYNSEVFKGMKLLSLSSDIPEKEGLGIAKQLKDKIKETIERIIEIEKEIRN<br>(SEQ ID NO: 145) |
| Porphyromonas<br>gingivalis | WP_021663197 | MNTVPASENKGQSRTVEDDPQYFGLYLNLARENLIEVESHVRIKFGK<br>KKLNEESLKQSLLCDHLLSVDRWTKVYGHSRRYLPFLHYFDPDSQIE<br>KDHDSKTGVDPDSAQPvLIRELYSLLDFLRNDFSFINRLDGTTFEHLEVS<br>PDISSFITGTYSLACGELAQSRFADFFKPDDFVLAKNRKEQLISVADGKE<br>CLTVSGLAFFICLFLDREQASGMLSRIRGFKRTDENWARAVHETFCDL<br>CIRHPFIDRLESSNTKEALLLDMLNELNRCPRILYDMLPEEERAQFLPA<br>LDENSMNNLSENSLNEESRLLWDGSSDWAEALTKRIRHQDRFPYLML<br>RFIEEMDLLKGIRFRVDLGEIELDSYSKKVGRNGEYDRTITDHALAFG<br>KLSDFQNEEEVSRMISGEASYPVRFSLFAPRYAIYDNKIGYCHTSDPVY<br>PKSKTGEKRALSNPRSMGFISVHDLRKLLLMELLCEGSFSRMQSDFLR<br>KANRILDETAEGKLQFSALFPEMRHRFIPPQNPKSKDRREKAETTLEK<br>YKQEIKGRKDKLNSQLLSAFDMDQRQLPSRLLDEWMNIRPASFISVKL<br>RTYVKQLNEDCRLRLQKFRKDGDGKARAIPLVGEMATFLSQDIVRMII<br>SEETKKLITSAYYNEMQRSLAQYAGEENRHQFRAIVAELRLLDPSSGH<br>PPFLSATMETAHRYTEDFYKCYLEKKREWLAKTFYRPEQDENTKRRIS<br>VPFFVPDGEARKLLPLLIRRRMKEQNDLQDWIRNKQAHPIDLPSHLFDS<br>KIMELLKVKDGKKKWNEAFKDWWSTKYPDGMQPPYGLRRELNIHG<br>KSVSYIPSDGKKFADCYTHLMEKTVQDKKRELRTAGKPVPPDLAADI |

|  |  |  |
|---|---|---|
|  |  | KRSFFTRAVNEREFMLRLVQEDDRLMLMATNKMMTDREEDTLPGLKNI<br>DSILDEENQFSLAVHAKVLEKEGEGGDNSLSLVPATIEIKSKRKDWSK<br>YIRYRYDRRVPGLMSHFPEHKATLDEVKTLLGEYDRCRIKIFDWAFAL<br>EGAIMSDRDLKPYLHESSSREGKSGEHSTLVKMLVEKKGCLTPDESQ<br>YLILIRNKAAHNQFPCAAEMPLIYRDVSAKVGSIEGSSAKDLPEGSSLV<br>DSLWKKYEMIIRKILPILDPENRFFGKLLNNMSQPINDL<br>(SEQ ID NO: 146) |
| *Porphyromonas*<br>*gingivalis* | WP_021665475 | MNTVPASENKGQSRTVEDDPQYFGLYLNLARENLIEVESHVRIKFGK<br>KKLNEESLKQSLLCDHLLSVDRWTKVYGFISRRYLPFLHYFDPDSQIE<br>KDFTDSKTGVDPDSAQRLIRELYSLLDFLRNDFSFFNRLDGTTFEHLEVS<br>PDISSFITG1YSLACGRAQSRFADFFKPDDFVLAKNRKEQLISVADGKE<br>CLTYSGLAFFICLFLDREQASGMLSRIRGFKRTNENWARAVHETFCDL<br>CIRHPHDRLESSSNTKEALLLDMLNELNRCPRILYDMLPEEERAQFLPA<br>LDENSMNNLSENSLNEESRLLWDGSSDWAEALTKRIRHQDRFPYLML<br>RFIEEMDLLKGIRFRVDLGEIELDSYSKKVGRNGEYDRTITDFSALAFG<br>KLSDFQNEEEVSRMTSGEASYPVRFSLFAPRYAIYDNKIGYCHTSDPVY<br>PKSKTGEKRALSNPQSMGFISVHDLRKLLLMELLCEGSFSRMQSGFLR<br>KANRILDETAFGKLQFSALFPEMRHRFIPPQNPKSKDRREKAETTLEK<br>YKQEIKGRKDKLNSQLLSAFDMNQRQLPSRLLDEWMNIRASHSVKL<br>RTYVKQLNEDCRLRLRKFRKDGDGKARAIPLVGEMATFLSQDIVRMII<br>SEETKKLLTTSAYYNEMQRSLAQYAGEENRRQFRAIVAELHLLDPSSGH<br>PFLSATMETAHRYTEDFYKCYLEKKREWLAKTFYRPEQDENTKRRIS<br>VFFYPDGEARKLLPLLIRRRMKEQNDLQDWIRNKQAHPIDLPSHLFDS<br>KIMELLKVKDGKKKWNEAFKDWWSTKYPDGMQPFYGLRRELNIHG<br>KSVSYIPSDGKKFADCYTHLMEKTVQDKKRELRTAGKPVPPDLAADI<br>KRSFHRAVNEREFMLRLVQEDDRLMLMAINKMMTDREEDILPGLKNI<br>DSILDKENQFSLAVHAKVLEKEGEGGDNSLSLVPATIEIKSKRKDWSK<br>YTRYRYDRRVPGLMSFTFPEFTKATLDEVKTLLGEYDRCRIKIFDWAFAL<br>EGAIMSDRDLKPYLHESSSREGKSGEHSTLVKMLVEKKGCLTPDESQ<br>YLILIRNKAAHNQFPCAAEMPLIYRDVSAKVGSIEGSSAKDLPEGSSLV<br>DSLWKKYEMIIRKILPILDHENRFFGKLLNNMSQPINDL<br>(SEQ ID NO: 147) |
| *Porphyromonas*<br>*gingivalis* | WP_021677657 | MNTVPASENKGQSRTVEDDPQYFGLYLNLARENLIEVESHVRIKFGK<br>KKLNEESLKQSLLCDHLLSVDRWTKWGHSRRYLPFLHYFDPDSQIE<br>KDHDSKTGVDPDSAQRLIRELYSLLDFLRNDFSHNRLDGTTFEFSLEVS<br>PDISSFITGTYSLACGRAQSRFADFFKPDDFVLAKNRKEQLISVADGKE<br>CLTVSGLAFFICLFLDREQASGMLSRIRGFKRTDENWARAVHETFCDL<br>CIRHPHDRLESSSNTKEALLLDMLNELNRCPRILYDMLPEEERAQFLPA<br>LDENSMNNLSENSLNEESRLLWDGSSDWAEALTKRIRHQDRFPYLML<br>RFIEEMDLLKGIRFRVDLGEIELDSYSKKVGRNGEYDRTITDHALAFG<br>KLSDFQNEEEVSRMISGEASYPVRFSLFAPRYAIYDNKIGYCHTSDPVY<br>PKSKTGEKRALSNPQSMGFISVHDLRKLLLMELLCEGSFSRMQSGFLR<br>KANRTLDETAEGKLQFSALFPEMRHRFIPPQNPKSKDRREKAETTLEK<br>YKQEIKGRKDKLNSQLLSAFDMNQRQLPSRLLDEWMNIRPASHSVKL<br>RTYVKQLNEDCRLRLRKFRKDGDGKARAIPLVGEMATFLSQDIVRMII<br>SEETKKLITSAYYNEMQRSLAQYAGEENRRQFRAIVAELHLLDPSSGH<br>PFLSATMETAHRYTEDFYKCYLEKKREWLAKTFYRPEQDENTKRRIS<br>VFFVPDGEARKLLPLLIRRRMKEQNDLQDWIRNKQAHPIDLPSHLFDS<br>KIMELLKVKDGKKKWNEAFKDWWSTKYPDGMQPFYGLRRELNIHG<br>KSVSYIPSDGKKFADCYTHLMEKTVQDKKRELRTAGKPVPPDLAADI<br>KRSFHRAVNEREFMLRLVQEDDRLMLMAINKMMTDREEDILPGLKNI<br>DSILDEENQFSLAVHAKVLEKEGEGGDNSLSLVPATIEIKSKRKDWSK<br>YIRYRYDRRVPGLMSHFPEHKATLDEVKTLLGEYDRCRIKIFDWAFAL<br>EGAIMSDRDLKPYLHESSSREGKSGEHSTLVKMLVEKKGCLTPDESQ<br>YLILIRNKAAHNQFPCAAEMPLIYRDVSAKVGSIEGSSAKDLPEGSSLV<br>DSLWKKYEMIIRKILPILDHENRFFGKLLNNMSQPINDL<br>(SEQ ID NO: 148) |
| *Porphyromonas*<br>*gingivalis* | WP_021680012 | MNTVPASENKGQSRTVEDDPQYFGLYLNLARENLIEVESHVRIKFGK<br>KKLNEESLKQSLLCDHLLSVDRWTKVYGHSRRYLPFLHYFDPDSQIE<br>KDHDSKTGVDPDSAQRLIRELYSLLDFLRNDFSHNRLDGTTFEHLEVS<br>PDISSFITGTYSLACGRAQSRFADFFKPDDFVLAKNRKEQLISVADGKE<br>CLTVSGLAFFICLFLDREQASGMLSRIRGFKRTDENWARAVHETFCDL<br>CIRHPHDRLESSSNTKEALLLDMLNELNRCPRILYDMLPEEERAQFLPA<br>LDENSMNNLSENSLNEESRLLWDGSSDWAEALTKRIRHQDRFPYLML<br>RFIEEMDLLKGIRFRVDLGEIELDSYSKKVGRNGEYDRTITDHALAFG<br>KLSDFQNEEEVSRMISGEASYPVRFSLFAPRYAIYDNKIGYCHTSDPVY<br>PKSKTGEKRALSNPRSMGFISVHDLRKLLLMELLCEGSFSRMQSDFLR<br>KANRILDETAEGKLQFSALFPEMRHRFIPPQNPKSKDRREKAETTLEK<br>YKQEIKGRKDKLNSQLLSAFDMDQRQLPSRLLDEWMNIRPASHSVKL<br>RTYVKQLNEDCRLRLQKFRKDGDGKARAIPLVGEMATFLSQDIVRMII<br>SEETKKLITSAYYNEMQRSLAQYAGEENRHQFRAIVAELRLLDPSSGH<br>PFLSATMETAHRYTEDFYKCYLEKKREWLAKTFYRPEQDENTKRRIS<br>VFFVPDGEARKLLPLLIRRRMKEQNDLQDWIRNKQAHPIDLPSHLFDS<br>KVMELLKVKDGKKKWNEAFKDWWSTKYPDGMQPFYGLRRELNIHG<br>KSVSYIPSDGKKFADCYTHLMEKTVRDKKRELRTAGKPVPPDLAAYI<br>KRSFHRAVNEREFMLRLVQEDDRLMLMAINKIMTDREEDILPGLKNI<br>DSILDKENQFSLAVHAKVLEKEGEGGDNSLSLVPATIEIKSKRKDWSK |

-continued

```
                           YIRYRYDRRVPGLMSHFPEHKATLDEVKTLLGEYDRCRIKIFDWAFAL
                           EGAIMSDRDLKPYLHESSSREGKSGEHSTLVKMLVEKKGCLTPDESQ
                           YLILIRNKAAHNQFPCAAEIPLIYRDVSAKVGSIEGSSAKDLPEGSSLV
                           DSLWKKYEMIIRKILPILDPENRFFGKLLNNMSQPINDL
                           (SEQ ID NO: 149)

Porphyromonas    WP_023846767    MNTVPASENKGQSRTVEDDPQYFGLYLNLARENLIEVESHVRIKFGK
gingivalis                       KKLNEESLKQSLLCDHLLSVDRWTKVYGHSRRYLPFLHYFDPDSQIE
                                 KDHDSKTGVDPDSAQRLIRELYSLLDFLRNDFSHNRLDGTTFEHLEVS
                                 PDISSFITGTYSLACGRAQSRFADFFKPDDFVLAKNRKEQLISVADGKE
                                 CLTVSGLAFFICLFLDREQASGMLSRIRGFKRTDENWARAVHETFCDL
                                 CIRHPHDRLESSNTKEALLLDMLNELNRCPRILYDMLPEEERAQFLPA
                                 LDENSMNNLSENSLNEESRLLWDGSSDWAEALTKRIRHQDRFPYLML
                                 RFIEEMDLLKGIRFRVDLGEIELDSYSKKVGRNGEYDRTITDHALAFG
                                 KLSDFQNEEEVSRMISGEASYPVRFSLFAPRYAIYDNKIGYCHTSDPVY
                                 PKSKTGEKRALSNPRSMGFISVHDLRKLLLMELLCEGSFSRMQSDFLR
                                 KANRILDETAEGKLQFSALFPEMRHRFIPPQNPKSKDRREKAETTLEK
                                 YKQEIKGRKDKLNSQLLSAFDMNQRQLPSRLLDEWMNIRPASHSVKL
                                 RTYVKQLNEDCRLRLRKFRKDGDGKARAIPLVGEMATFLSQDIVRMII
                                 SEETKKLITSAYYNEMQRSLAQYAGEENRRQFRAIVAELHLLDPSSGH
                                 PFLSATMETAHRYTEDFYKCYLEKKREWLAKTFYRPEQDENTKRRIS
                                 VFFVPDGEARKLLPLLIRRRMKEQNDLQDWIRNKQAHPIDLPSHLFDS
                                 KIMELLKVDGKKKWNEAFKDWWSTKYPDGMQPFYGLRRELNIHG
                                 KSVSYIPSDGKKFADCYTHLMEKTVQDKKRELRTAGKPVPPDLAADI
                                 KRSFHRAVNEREFMLRLVQEDDRLMLMAINKMMTDREEDILPGLKNI
                                 DSILDEENQFSLAVHAKVLEKEGEGGDNSLSLVPATIEIKSKRKDWSK
                                 YIRYRYDRRVPGLMSHFPEFHKATLDEVKTLLGEYDRCRIKIFDWAFAL
                                 EGAIMSDRDLKPYLHESSSREGKSGEHSTLVKMLVEKKGCLTPDESQ
                                 YLILIRNKAAHNQFPCAAEMPLIYRDVSAKVGSIEGSSAKDLPEGSSLV
                                 DSLWKKYEMIIRKILPILDPENRFFGKLLNNMSQPINDL
                                 (SEQ ID NO: 150)

Prevotella       WP_036884929    MKNDNNSTKSTDYTLGDKHFWAAFLNLARHNVYITVNHINKVLELK
falsenii                         NKKDQEIIIDNDQDILAIKTLWGKVDTDINKKDRLRELIMKHFPPFLEAA
                                 TYQQSSTNNTKQKEEEQAKAQSFESLKDCLFLFLEKLREARNYYSHY
                                 KHSKSLEEPKLEEKLLENMYNIFDTNVQLVIKDYEHNKDINPEEDFKH
                                 LGRAEGEFNYYFTRNKKGNITESGLLFFVSLFLEKKDAIWAQTKIKGF
                                 KDNRENKQKMTHEVFCRSRMLLPKLRLESTQTQDWILLDMLNELIRC
                                 PKSLYKRLQGEKREKFRVPFDPADEDYDAEQEPFKNTLVRHQDRFPY
                                 FALRYFDYNEIFTNLRFQIDLGTYHFSIYKKQIGDKKEDRHLTHKLYGF
                                 ERIQEFAKENRPDEWKALVKDLDTFEESNEPYISETTPHYHLENQKIGI
                                 RNKNKKKKKTIWPSLETKTTVNERSKYNLGKSFKAEAFLSVHELLPM
                                 MFYYLLLNKEEPNNGKINASKVEGIIEKKIRDIYKLYGAFANEEINNEE
                                 ELKEYCEGKDIAIRHLPKQMIAILKNEYKDMAKKAEDKQKKMIKDTK
                                 KRLAALDKQVKGEVEDGGRNIKPLKSGRIASWLVNDMMRFQPVQRD
                                 RDGYPLNNSKANSTEYQLLQRTLALFGSERERLAPYFRQMNLIGKDN
                                 PHPFLKDTKWKEHNNILSFYRSYLEAKKNFLGSLKPEDWKKNQYFLK
                                 LKEPKTNRETLVQGWKNGFNLPRGIFTEPIREWFIRHQNESEEYKKVK
                                 DFDRIGLVAKVIPLFFKEDYQKEIEDYVQPFYGYPFNVGNIHNSQEGTF
                                 LNKKEREELWKGNKTKFKDYKTKEKNKEKTNKDKFKKKTDEEKEEF
                                 RSYLDFQSWKKFERELRLVRNQDIVTWLLCMELIDKLKIDELNIEELQ
                                 KLRLKDIDTDTAKKEKNNILNRIMPMELPVTVYETDDSNNIIKDKPLH
                                 TIYIKEAETKLLKQGNFKALVKDRRLNGLFSFVETSSEAELKSKPISKS
                                 LVEYELGEYQRARVEIIKDMLRLEETLIGNDEKLPTNKFRQMLDKWL
                                 EHKKETDDTDLKNDVKLLTEVRNAFSHNQYPMRDRIAFANIKPFSLSS
                                 ANTSNEEGLGIAKKLKDKTKETIDRIIEIEEQTATKR (SEQ ID NO: 151)

Prevotella       WP_036931485    MENDKRLEESTCYTLNDKHFWAAFLNLARHNVYITINHINKLLEIRQI
pleuritidis                      DNDEKVLDIKALWQKVDKDINQKARLRELMIKHFPFLEAAIYSNNKE
                                 DKEEVKEEKQAKAQSFKSLKQCLFLFLEKLQEARNYYSHYKSSESSK
                                 EPEFEEGLLEKMYNTFGVSIRLVKEDYQYNKDIDPEKDFKHLERKEDF
                                 NYLFTDKDNKGKITKNGLLFFVSLFLEKKDAIWMQQKLRGFKDNRG
                                 NKEKMTHEVFCRSRMLLPKIRLESTQTQDWILLDMLNELIRCPKSLYE
                                 RLQGAYREKFKVPFDSIDEDYDAEQEPFRNTLVRHQDRFPYFALRYFD
                                 YNEIFKNLRFQIDLGTYHFSIYKKLIGDNKEDRHLTHKLYGFERIQEFA
                                 KQKRPNEWQALVKDLDIYETSNEQYISETTPHYHLENQKIGIRFKNKE
                                 DKIWPSLETNGKENEKSKYNLDKSFQAEAFLSIHELLPMMFYDLLLKK
                                 EEPNNDEKNASIVEGFIKKEIKRMYAIYDAFANEEINSKEGLEEYCKN
                                 KGFQERHLPKQMIAILTNKSKNMAEKAKRKQKEMIKDTKKRLATLD
                                 KQVKGEIEDGGRNIRLLKSGEIARWLVNDMMRFQSVQKDKEGKPLN
                                 NSKANSTEYQMLQRSLALYNKEQKPTPYFIQVNLIKSSNPHPFLEETK
                                 WEECNNILSFYRSYLEAKKNFLESLKPEDWKKNQYFLMLKEPKTNRK
                                 TLVQGWKNGFNLPRGIFTEPIKEWFKRHQNDSEEYKKVEALDRVGLV
                                 AKVIPLFFKEEYFKEDAQKEINCVQPFYSFPYNVGNIHKPEEKNFLHC
                                 EERRKLWDKKKDFKGYKAKEKSKKMTDKEKEEHRSYLEFQSWNK
                                 FERELRLVRNQDIVTWLLCTELIDKLKIDELNIEELQKLRLKDIDTDTA
                                 KKEKNNILNRIMPMQLPVTVYEIDKSFNIVKDKPLHTIYIEETGTKLLK
```

-continued

|  |  | QGNFKALVKDRRLNGLFSFVKTSSEAESKSKPISKLRVEYELGAYQKA<br>RIDIIKDMLALEKTLIDNDENLPTNKFSDMLKSWLKGKGEANKARLQ<br>NDVDLLVAIRNAFSHNQYPMYNSEVFKGMKLLSLSSDIPEKEGLGIAK<br>QLKDKIKETIERIIEIEKEIRN (SEQ ID NO: 152) |
|---|---|---|
| [Porphyromonas<br>gingivalis | WP_039417390 | MTEQNERPYNGTYYTLEDKHFWAAFFNLARHNAYITLAHIDRQLAYS<br>KADITNDEDILFFKGQWKNLDNDLERKARLRSLILKHFSFLEGAAYGK<br>KLFESQSSGNKSSKKKELTKKEKEELQANALSLDNLKSILFDFLQKLK<br>DFRNYYSHYRHPESSELPLFDGNMLQRLYNVFDVSVQRVKRDHEHN<br>DKVDPHRHFNHLVRKGKKDRYGNNDNPFFKHHFVDREGTVTEAGLL<br>FFVSLFLEKRDAIWMQKKIRGFKGGTEAYQQMTNEVFCRSRISLPKLK<br>LESLRTDDWMLLDMLNELVRCPKSLYDRLREEDRARFRVPIDILSDED<br>DTDGTEEDPFKNTLVRHQDRFPYFALRYFDLKKVFTSLRFHIDLGTYH<br>FAIYKKNIGEQPEDRHLTRNLYGFGRIQDFAEEHRPEEWKRLVRDLDY<br>FETGDKPYITQTTPHYHIEKGKIGLRFVPEGQHLWPSPEVGATRTGRS<br>KYAQDKRLTAEAFLSVHELMPMMFYYFLLREKYSEEVSAEKVQGRIK<br>RVIEDVYAVYDAFARGEIDTLDRLDACLADKGIRRGHLPRQMIAILSQ<br>EHKDMEEKVRKKLQEMIADTDHRLDMLDRQTDRKIRIGRKNAGLPK<br>SGVIADWLVRDMMRFQPVAKDTSGKPLNNSKANSTEYRMLQRALAL<br>FGGEKERLTPYFRQMNLTGGNNPHPFLHETRWESHTNILSFYRSYLKA<br>RKAFLQSIGRSDREENHRFLLLKEPKTDRQTLVAGWKSEFHLPRGIFT<br>EAVRDCLIEMGYDEVGSYKEVGFMAKAVPLYFERACKDRVQPFYDY<br>PFNVGNSLKPKKGRFLSKEKRAEEWESGKERFRLAKLKKEILEAKEHP<br>YLDPFKSWQKFERELRLVKNQDIITWMMCRDLMEENKVEGLDTGTLY<br>LKDIRTDVHEQGSLNVLNRVKPMRLPVVVYRADSRGHVHKEQAPLA<br>TVYIEERDTKLLKQGNFKSFVKDRRLNGLFSFVDTGALAMEQYPISKL<br>RVEYELAKYQTARVCAFEQTLELEESLLTRYPHLPDKNFRKMLESWS<br>DPLLDKWPDLHRKVRLLIAVRNAFSHNQYPMYDEAVFSSIRKYDPSSP<br>DAIEERMGLNIAHRLSEEVKQAKEMAERIIQV (SEQ ID NO: 153) |
| Porphyromonas<br>gulae | WP_039418912 | MTEQSERPYNGTYYTLEDKHFWAAFLNLARHNAYITLTHIDRQLAYS<br>KADITNDQDVLSFKALWKNLDNDLERKSRLRSLILKHFSFLEGAAYG<br>KKLFESKSSGNKSSKNKELTKKEKEELQANALSLDNLKSILFDFLQKL<br>KDFRNYYSHYRHSGSSELPLFDGNMLQRLYNVFDVSVQRVKRDHEH<br>NDKVDPHRHFNHLVRKGKKDRYGHNDNPSFKHHFVDSEGMVTEAG<br>LLFFVSLFLEKRDAIWMQKKIRGFKGGTETYQQMTNEVFCRSRISLPK<br>LKLESLRMDDWMLLDMLNELVRCPKPLYDRLREDDRACFRVPVDILP<br>DEDDTDGGGEDPFKNTLVRHQDRFPYFALRYFDLKKVFTSLRFHIDL<br>GTYHFAIYKKMIGEQPEDRHLTRNLYGFGRIQDFAEEHRPEEWKRLV<br>RDLDYFETGDKPYISQTSPHYHIEKGKIGLRFMPEGQHLWPSPEVGTT<br>RTGRSKYAQDKRLTAEAFLSVHELMPMMFYYFLLREKYSEEVSAEK<br>VQGRIKRVIEDVYAIYDAFARDEINTLKELDACLADKGIRRGHLPKQM<br>IAILSQEHKNMEEKVRKKLQEMIADTDHRLDMLDRQTDRKIRIGRKN<br>AGLPKSGVIADWLVRDMMRFQPVAKDASGKPLNNSKANSTEYRMLQ<br>RALALFGGEKERLTPYFRQMNLTGGNNPHPFLHDTRWESHTTNILSFY<br>RSYLRARKAFLERIGRSDRMENRPFLLLKEPKTDRQTLVAGWKSEFH<br>LPRGIFTEAVRDCLIEMGYDEVGSYREVGFMAKAVPLYFERACEDRV<br>QPFYDSPFNVGNSLKPKKGRFLSKEERAEEWERGKERFRDLEAWSHS<br>AARRIEDAFAGIEYASPGNKKKIEQLLRDLSLWEAFESKLKVRADKIN<br>LAKLKKEILEAQEHPYHDFKSWQKFERELRLVKNQDIITWMMCRDL<br>MEENKVEGLDTGTLYLKDIRTNVQEQGSLNVLNHVKPMRLPVVVYR<br>ADSRGHVHKEEAPLATYYIEERDTKLLKQGNFKSFVKDRRLNGLFSF<br>VDTGGLAMEQYPISKLRVEYELAKYQTARVCAFEQTLELEESLLTRYP<br>HLPDKNFRKMLESWSDPLLAKWPELHGKVRLLIAVRNAFSHNQYPM<br>YDEAVFSSIRKYDPSSPDAIEERMGLNIAHRLSEEVKQAKETVERIIQA<br>(SEQ ID NO: 154) |
| Porphyromonas<br>gulae | WP_039419792 | MTEQSERPYNGTYYTLEDKHFWAAFLNLARHNAYITLTHIDRQLAYS<br>KADITNDQDVLSFKALWKNLDNDLERKSRLRSLILKHFSFLEGAAYG<br>KKLFESKSSGNKSSKNKELTKKEKEELQANALSLDNLKSILFDFLQKL<br>KDFRNYYSHYRHSGSSELPLFDGNMLQRLYNVFDVSVQRVKRDHEH<br>NDKVDPHRHFNHLVRKGKKDRYGHNDNPSFKHHFVDGEGMVTEAG<br>LLFFVSLFLEKRDAIWMQKKIRGFKGGTETYQQMTNEVFCRSRISLPK<br>LKLESLRTDDWMLLDMLNELVRCPKPLYDRLREKDRARFRVPVDILP<br>DEDDTDGGGEDPFKNTLVRHQDRFPYFALRYFDLKKVFTSLRFHIDL<br>GTYHFAIYKKVIGEQPEDRHLTRNLYGFGRIQDFAEEHRPEEWKRLVR<br>DLDYFETGDKPYISQTTPHYHIEKGKIGLRFVPEGQHLWPSPEVGTTRT<br>GRSKYAQDKRLTAEAFLSVHELMPMMFYYFLLREKYSEEVSAEKVQ<br>GRIKRVIEDVYAIYDAFARDEINTRDELDACLADKGIRRGHLPKQMIGI<br>LSQEHKNMEEKVRKKLQEMIADTDHRLDMLDRQTDRKIRIGRKNAG<br>LPKSGVIADWLVRDMMRFQPVAKDTSGKPLNNSKANSTEYRMLQRA<br>LALFGGEKERLTPYFRQMNLTGGNNPHPFLDETRWESHTNILSFYRSY<br>LRARKAFLERIGRSDRVENRPFLLLKEPKTDRQTLVAGWKSEFHLPRG<br>IFTEAVRDCLIEMGYDEVGSYKEVGFMAKAVPLYFERACKDRVQPFY<br>DSPFNVGNSLKPKKGRFLSKEKRAEEWESGKERFRLAKLKKEILEAQE<br>HPYHDFKSWQKFERELRLVKNQDIITWMMCRDLMEENKVEGLDTGT<br>LYLKDIRPNVQEQGSLNVLNRVKPMRLPVVVYRADSRGHVHKEEAP<br>LATYYIEERDTKLLKQGNFKSFVKDRRLNGLFSFVDTGGLAMEQYPIS<br>KLRVEYELAKYQTARVCVFELTLRLEESLLSRYPHLPDESFREMLESW |

| | | |
|---|---|---|
| | | SDPLLAKWPELHGKVRLLIAVRNAFSHNQYPMYDEAVFSSIRKYDPSS
PDAIEERMGLNIAHRLSEEVKQAKETVERIIQA (SEQ ID NO: 155) |
| *Porphyromonas gulae* | WP_039426176 | MTEQSERPYNGTYYTLEDKHFWAAFLNLARHNAYITLTHIDRQLAYS
KADITNDQDVLSFKALWKNFDNDLERKSRLRSLILKHFSFLEGAAYG
KKLFESKSSGNKSSKNKELTKKEKEELQANALSLDNLKSILFDFLQKL
KDFRNYYSHYRHSGSSELPLFDGNMLQRLYNVFDVSVQRVKRDHEH
NDKVDPHYHFNHLVRKGKKDRYGHNDNPSFKHHFVDSEGMVTEAG
LLFFVSLFLEKRDAIWMQKKIRGFKGGTGPYEQMTNEVFCRSRISLPK
LKLESLRTDDWMLLDMLNELVRCPKPLYDRLREKDRACFRVPVDILP
DEDDTDGGGEDPFKNTLVRHQDRFPYFALRYFDLKKVFTSLRFHIDL
GTYHFAIYKKMGEQPEDRHLTRNLYGFGRIQDFAEEHRPEEWKRLV
RDLDYFETGDKPYISQTTPHYHIEKGKIGLRFMPEGQHLWPSPEVGTT
RTGRSKYAQDKRLTAEAFLSVHELMPMMFYYFLLREKYSEEVSAEK
VQGRIKRVIKDVYAIYDAFARDEINTLKELDACSADKGIRRGHLPKQM
IGILSQEHKNMEEKVRKKLQEMIADTDHRLDMLDRQTDRKIRIGRKN
AGLPKSGVIADWLVRDMMRFQPVAKDTSGKPLNNSKANSTEYRMLQ
RALALFGGEKERLTPYFRQMNLTGGNNPHPFLDETRWESHTNILSFYR
SYLRARKAFLERIGRSDRVENRPPLLLKEPKNDRQTLVAGWKSEFHLP
RGIFTEAVRDCLIEMGYDEVGSYKEVGFMAKAVPLYFERACKDRVQP
FYDSPFNVGNSLKPKKGRFLSKEKRAEEWESGKERFRLAKLKKEILEA
KEHPYHDFKSWQKFERELRLVKNQDIITWMMCRDLNIEENKVEGLDT
GTLYLKDIRTDVHEQGSLNVLNRVKPMRLPVVVYRADSRGHVHKEQ
APLATVYIEERDTKLLKQGNFKSFVKDRRLNGLFSFVDTGGLAMEQY
PISKLRVEYELAKYQTARVCAFEQTLELEESLLTRYPHLPDENFREML
ESWSDPLLGKWPDLHGKVRLLIAVRNAFSHNQYPMYDEAVFSSIRKY
DPSSPDAIEERMGLNIAHRLSEEVKQAKETVERIIQA (SEQ ID NO: 156) |
| *Porphyromonas gulae* | WP_039431778 | MTEQSERPYNGTYYTLEDKHFWAAFLNLARHNAYITLTHIDRQLAYS
KADITNDQDVLSFKALWKNFDNDLERKSRLRSLILKHFSFLEGAAYG
KKLFESKSSGNKSSKNKELTKKEKEELQANALSLDNLKSILFDFLQKL
KDFRNYYSHYRHSESSELPLFDGNMLQRLYNVFDVSVQRVKRDHEH
NDKVDPHRHFNHLVRKGKKDRYGHNDNPSFKHHFVDGEGMVTEAG
LLFFVSLFLEKRDAIWMQKKIRGFKGGTETYQQMTNEVFCRSRISLPK
LKLESLRTDDWMLLDMLNELVRCPKPLYDRLREDDRACFRVPVDILP
DEDDTDGGGEDPFKNTLVRHQDRFPYFALRYFDLKKVFTSLRFHIDL
GTYHFAIYKKMIGEQPEDRHLTRNLYGFGRIQDFAEEHRPEEWKRLV
RDLDYFETGDKPYISQTSPHYHIEKGKIGLRFMPEGQHLWPSPEVGTT
RTGRSKYAQDKRLTAEAFLSVHELMPMMFYYFLLREKYSEEVSAEK
VQGRIKRVIEDVYAYDAFARDEINTLKELDACLADKGIRRGHLPKQM
IAILSQEHKDMEEKIRKKLOEMIADTDHRLDMLDRQTDRKIRIGRKNA
GLPKSGVIADWLVRDMMRFQPVAKDTSGKPLNNSKANSTEYRMLQR
ALALFGGEKKRLTPYFRQMNLTGGNNPHPFLHETRWESHTNILSFYRS
YLRARKAFLERIGRSDRMENRPFLLLKEPKTDRQTLVAGWKSEFHLP
RGIFTEAVRDCLIEMGYDEVGSYREVGFMAKAVPLYFERACEDRVQP
FYDSPFNVGNSLKPKKGRFLSKEERAEEWERGKERFRDLEAWSHSAA
RRIEDAFAGIEYASPGNKKKIEQLLRDLSLWEAFESKLKVRADKINLA
KLKKEILEAQEHPYHDFKSWQKFERELRLVKNQDIITWMMCRDLMEE
NKVEGLDTGTLYLKDIRPNVQEQGSLNVLNRVKPMRLPVVVYRADS
RGHVHKEEAPLATVYIEERDTKLLKQGNFKSFVKDRRLNGLFSFVDT
GGLAMEQYPISKLRVEYELAKYQTARVCVFELTLRLEESLLTRYPHLP
DESFRKMLESWSDPLLAKWPELHGKVRLLIAVRNAFSHNQYPMYDE
AVFSSIRKYDPSSPDAIEERMGLNIAHRLSEEVKQAKETVERIIQV
(SEQ ID NO: 157) |
| *Porphyromonas gulae* | WP_039437199 | MTEQSERPYNGTYYTLEDKHFWAAFLNLARHNAYITLTHIDRQLAYS
KADITNDEDILFFKGQWKNLDNDLERKSRLRSLILKHFSFLEGAAYGK
KFFESKSSGNKSSKNKELTKKEKEELQANALSLDNLKSILFDFLQKLK
DFRNYYSHYRHSGSSELPLFDGNMLQRLYNVFDVSVQRVKRDHEHN
DEVDPHYHFNHLVRKGKKDRYGHNDNPSFKHHFVDGEGMVTEAGL
LFFVSLFLEKRDAIWMQKKIRGFKGGTEPYEQMTNEVFCRSRISLPKL
KLESLRTDDWMLLDMLNELVRCPKPLYDRLREKDRACFRVPVDILPD
EDDTDGGGEDPFKNTLVRHQDRFPYFALRYFDLKKVFTSLRFHIDLGT
YHFAIYKKMGEQPEDRHLTRNLYGFGRIQDFAEEHRPEEWKRLVRD
LDYFETGDKPYISQTTPHYHIEKGKIGLRFVPEGQHLWPSPEVGTTRTG
RSKYAQDKRLTAEAFLSVHELMPMMFYYFLLREKYSEEVSAEKVQG
RIKRVIEDVYAIYDAFARDEINTLKELDACLADKGIRRGHLPKQMIGIL
SQERKDMEEKVRKKLQEMIADTDHRLDMLDRQTDRKIRIGRKNAGL
PKSGVIADWLVRDMMRFQPVAKDTSGKPLNNSKANSTEYRMLQRAL
ALFGGEKERLTPYFRQMNLTGGNNPHPFLHETRWESHTNILSFYRSYL
RARKAFLERIGRSDRVENCPFLLLKEPKTDRQTLVAGWKGEFHLPRGI
FTEAVRDCLIEMGYDEVGSYREVGFMAKAVPLYFERACEDRVQPFYD
SPFNVGNSLKPKKGRFLSKEKRAEEWESGKERFRLAKLKKEILEAQEH
PYHDFKSWQKFERELRLVKNQDIITWMMCRDLMEENKVEGLDTGTL
YLKDIRPNVQEQGSLNVLNRVKPMRLPVVVYRADSRGHVHKEEAPL
ATVYIEERDTKLLKQGNFKSFVKDRRLNGLFSFVDTGALAMEQYPISK
LRVEYELAKYQTARVCAFEQTLELEESLLTRYPHLPDESFREMLESWS
DPLLTKWPELHGKVRLLIAVRNAFSHNQYPMYDEAVFSSIWKYDPSS
PDAIEERMGLNIAHRLSEEVKQAKETIERIIQA (SEQ ID NO: 158) |

-continued

| | | |
|---|---|---|
| Porphyromonas gulae | WP_039442171 | MTEQSERPYNGTYYTLEDKHFWAAFLNLARHNAYITLTHIDRQLAYS KADITNDQDVLSFKALWKNLDNDLERKSRLRSLILKHFSFLEGAAYG KKLFESKSSGNKSSKNKELTKKEKEELQANALSLDNLKSILFDFLQKL KDFRNYYSHYRHSGSSELPLFDGNMLQRLYNVFDVSVQRVKRDHEH NDKVDPHYHFNHLVRKGKKDRYGHNDNPSFKHHFVDSEGMVTEAG LLFFVSLFLEKRDAIWMQKKIRGFKGGTGPYEQMTNEVFCRSRISLPK LKLESLRTDDWMLLDMLNELVRCPKPLYDRLREKDRACFRVPVDILP DEDDTDGGGEDPFKNTLVRHQDRFPYFALRYFDLKKVFTSLRFHIDL GTYHFAIYKKMIGEQPEDRHLTRNLYGFGRIQDFAEEHRPEEWKRLV RDLDYLETGDKPYISQTTPHYHIEKGKIGLRFVPEGQHLWPSPEVGTT RTGRSKCAQDKRLTAEAFLSVHELMPMMFYYFLLREKYSEEVSAEKV QGRIKRVIEDVYAIYDAFARDEINTLKELDTCLADKGIRRGHLPKQMI TILSQERKDMKEKIRKKLQEMIADTDHRLDMLDRQTDRKIRIGRKNA GLPKSGVIADWLVRDMMRFQPVAKDASGKPLNNSKANSTEYRMLQR ALALFGGEKERLTPYFRQMNLTGGNNPHPFLHETRWESHTNILSFYRS YLRARKAFLERIGRSDRVENCPFLLLKEPKTDRQTLVAGWKDEFHLP RGIFTEAVRDCLIEMGYDEVGSYREVGFMAKAVPLYFERACEDRVQP FYDSPFNVGNSLKPKKGRFLSKEDRAEEWERGMERFRDLEAWSHSA ARRIKDAFAGIEYASPGNKKKIEQLLRDLSLWEAFESKLKVRADKINL AKLKKEILEAQEHPYHDFKSWQKFERELRLVKNQDIITWMMCRDLM EENKVEGLDTGTLYLKDIRPNVQEQGSLNVLNRVKPMRLPVVVYRA DSRGHVHKEAPLATVYIEERNTKLLKQGNFKSFVKDRRLNGLFSFVD TGGLAMEQYPISKLRVEYELAKYQTARVCVFELTLRLEESLLSRYPHL PDESFREMLESWSDPLLAKWPELHGKVRLLIAVRNAFSHNQYPMYDE AVFSSIRKYDPSSPDAIEERMGLNIAHRLSEEVKQAKETVERIIQA (SEQ ID NO: 159) |
| Porphyromonas gulae | WP_039445055 | MNTVPATENKGQSRTVEDDPQYFGLYLNLARENLIEVESHVRIKFGK KKLNEESLKQSLLCDHLLSIDRWTKVYGHSRRYLPFLHCFDPDSGIEK DHDSKTGVDPDSAQRLIRELYSLLDFLRNDFSHNRLDGTTFEHLKVSP DISSFITGAYTFACERAQSRFADFFKPDDFLLAKNRKEQLISVADGKEC LTVSGFAFFICLFLDREQASGMLSRIRGFKRTDENWARAVHETFCDLC IRHPHDRLESSNTKEALLLDMLNELNRCPRILYDMLPEEERAQFLPAL DENSMNNLSENSLNEESRLLWDGSSDWAEALTKRIRHQDRFPYLMLR FIEEMDLLKGIRFRVDLGEIELDSYSKKVGRNGEYDRTITDHALAFGK LSDFQNEEEVSRMISGEASYPVRFSLFAPRYAIYDNKIGYCHTSDPVYP KSKTGEKRALSNPQSMGFISVHDLRKLLLMELLCEGSFSRMQSDFLRK ANRILDETAEGKLQFSALFPEMRHRFIPPQNPKSKDRREKAETTLEKY KQEIKGRKDKLNSQLLSAFDMNQRQLPSRLLDEWMNIRPASHSVKLR TYVKQLNEDCRLRLRKFRKDGDGKARAIPLVGEMATFLSQDIVRMIIS EETKKLITSAYYNEMQRSLAQYAGEENRRQFRAIVAELHLLDPSSGHP FLSATMETAHRYTEDFYKCYLEKKREWLAKTFYRPEQDENTKRRISV FFVPDGEARKLLPLLIRRRMKEQNDLQDWIRNKQAHPIDLPSHLFDSK IMELLKVDGKKKWNEAFKDWWSTKYPDGMQPFYGLRRELNIHGK SVSYIPSDGKKFADCYTHLMEKTVRDKKRELRTAGKPVPPDLAAYIK RSPFHRAVNEREFMLRLVQEDDRLMLMAINKMMTDREEDILPGLKNID SILDEENQFSLAVHAKVLEKEGEGGDNSLSLVPATIEIKSKRKDWSKYI RYRYDRRVPGLMSHFPEHKATLDEVKTLLGEYDRCRIKIFDWAFALE GAIMSDRDLKPYLHESSSREGKSGEHSTLVKMLVEKKGCLTPDESQY LILIRNKAAHNQFPCAAEMPLIYRDVSAKVGSIEGSSAKDLPEGSSLVD SLWKKYEMIIRKILPILDHENRFFGKLLNNMSQPINDL (SEQ ID NO: 160) |
| Capnocytophaga cynodegmi | WP_041989581 | MENKTSLGNNIYYNPFKPQDKSYFAGYLNAAMENIDSVFRELGKRLK GKEYTSENFFDAIFKENISLVEYERYVKLLSDYFPMARLLDKKEVPIKE RKENFKKNFRGIIKAVRDLRNFYTHKEHGEVEITDEIFGVLDEMLKST VLTVKKKKIKTDKTKEILKKSIEKQLDILCQKKLEYLKDTARKIEEKRR NQRERGEKKLVPRFEYSDRRDDLIAAIYNDAFDVYIDKKKDSLKESSK TKYNTESYPQQEEGDLKIPISKNGVVFLLSLFLSKQEVHAFKSKIAGFK ATVIDEATVSHRKNSICFMATHEIFSHLAYKKLKRKVRTAEINYSEAE NAEQLSIYAKETLMMQMLDELSKVPDVVYQNLSEDVQKTFIEDWNE YLKENNGDVGTMEEEQVIHPVIRKRYEDKFNYFAIRFLDEFAQFPTLR FQVHLGNYLHDSRPKEHLISDRRIKEKITVFGRLSELEHKKALFIKNTE TNEDRKHYWEVFPNPNYDFPKENISVNDKDFPIAGSILDREKQPTAGK IGIKVNLLNQKYISEVDKAVKAHQLKQRNNKPSIQNIIEEIVPINGSNPK EIIVFGGQPTAYLSMNDIHSILYEFFDKWEKKKEKLEKKGEKELRKEIG KELEEKIVGKIQTQIQQIIDKDINAKILKPYQDDDSTAIDKEKLIKDLKQ EQKILQKLKNEQTAREKEYQECIAYQEESRKIKRSDKSRQKYLRNQLK RKYPEVPTRKEILYYQEKGKVAVWLANDIKRFMPTDFKNEWKGEQH SLLQKSLAYYEQCKEELKNLLPQQKVFKHLPFELGGHFQQKYLQFY TRYLDKRLEHISGLVQQAENFKNENKVFKKVENECFKPLKKQNYTHK GLDAQAQSVLGYPIFLERGFMDEKPTIIKGKTFKGNESLFTDWFRYYK EYQNFQTFYDTENYPLVELEKKQADRKRETKIYQQKKNDVFTLLMA KHIFKSVFKQDSIDRFSLEDLYQSREERLENQEKAKQTGERNTNYIWN KTVDLNLCDGKVTVENVKLKNVGNFIKYEYDQRVQTFLKYEENIKW QAFLIKESKEEENYPYIVEREIEQYEKVRREELLKEVHLIEEYILEKVKD KEILKKGDNQNFKYYILNGLLKQLKNEDVESYKVFNLNTKPEDVNIN QLKQEATDLEQKAFVLTYIRNKFAHNQLPKKEFWDYCQEKYGKIEKE KTYAEYFAEVFKREKEALMK (SEQ ID NO: 161) |

| | | |
|---|---|---|
| Prevotella sp. P5-119 | WP_042518169 | MNIPALVENQKKYFGTYSVMAMLNAQTVLDHIQKVADIEGEQNENN ENLWFHPVMSHLYNAKNGYDKQPEKTMFIIERLQSYFPFLKIMAENQ REYSNGKYKQNRVEVNSNDIFEVLKRAFGVLKMYRDLTNHYKTYEE KLIDGCEFLTSTEQPLSGMISKYYTVALRNTKERYGYKTEDLAFIQDNI KKITKDAYGKRKSQVNTGFFLSLQDYNGDTQKKLHLSGVGIALLICLF LDKQYINIFLSRLPIFSSYNAQSEERRIIRSFGINSIKLPKDRIHSEKSNKS VAMDMLNEVKRCPDELFTTLSAEKQSRFRIISDDHNEVLMKRSTDRF VPLLLQYIDYGKLFDHIRFHVNMGKLRYLLKADKTCIDGQTRVRVIEQ PLNGFGRLEEAETMRKQENGTFGNSGIRIRDFENVKRDDANPANYPYI VDTYTHYILENNKVEMFISDKGSSAPLLPLIEDDRYVVKTIPSCRMSTL EIPAMAFHMLFGSKKTEKLIVDVHNRYKRLFQAMQKEEVTAENIAS FGIAESDLPQKILDLISGNAHGKDVDAFIRLTVDDMLTDTERRIKRFKD DRKSIRSADNKMGKRGFKQISTGKLADFLAKDIVLFQPSVNDGENKIT GLNYRIMQSAIAVYDSGDDYEAKQQFKLMFEKARLIGKGTTEPHPFL YKVFARSIPANAVDFYERYLIERKFYLTGLCNEIKRGNRVDVPFIRRD QNKWKTPAMKTLGRIYSEDLPVELPRQMFDNEIKSHLKSLPQMEGIDF NNANVTYLIAEYMKRVLNDDFQTFYQWKRNYHMDMLKGEYDRK GSLQHCFTSVEEREGLWKERASRTERYRKLASNKIRSNRQMRNASSE EIETILDKRLSNCRNEYQKSEKVIRRYRVQDALLFLLAKKTLTELADF DGERFKLKEIMPDAEKGILSEIMPMSFTFEKGGKKYTITSEGMKLKNY GDFFVLASDKRIGNLLELVGSDIVSKEDIMEEFNKYDQCRPEISSIVFNL EKWAFDTYPELSARVDREEKVDFKSILKILLNNKNINKEQSDILRKIRN AFDHNNYPDKGIVEIKALPEIAMSIKKAFGEYAIMK (SEQ ID NO: 162) |
| Prevotella sp. P4-76 | WP_044072147 | MNIPALVENQKKYFGTYSVMAMLNAQTVLDHIQKVADIEGEQNENN ENLWFHPVMSHLYNAKNGYDKQPEKTMFIIERLQSYFPFLKIMAENQ REYSNGKYKQNRVEVNSNDIFEVLKRAFGVLKMYRDQASHYKTYDE KLIDGCEFLTSTEQPLSGMINNYYTVALRNMNERYGYKTEDLAFIQDK RFKFVKDAYGKKKSQVNTGFFLSLQDYNGDTQKKLHLSGVGIALLIC LFLDKQYINIFLSRLPIFSSYNAQSEERRIIRSFGINSIKQPKDRIHSEKSN KSVAMDMLNEIKRCPNELFETLSAEKQSRFRIISNDHNEVLMKRSSDR FVPLLLQYIDYGKLFDHIRFHVNMGKLRYLLKADKTCIDGQTRVRVIE QPLNGFGRLEEVETMRKQENGTFGNSGIRIRDFENMKRDDANPANYP YIVDTYTHYILENNKVEMFISDEETPAPLLPVIEDDRYVVKTIPSCRMS TLEIPAMAFHMLFGSKKTEKLIVDVHNRYKRLFKAMQKEEVTAENI ASFGIAESDLPQKIIDLISGNAHGKDVDAFIRLTVDDMLADTERRTKRF KDDRKSIRSADNKMGKRGFKQISTGKLADFLAKDIVLFQPSVNDGEN KITGLNYRIMQSAIAVYNSGDDYEAKQQFKLMFEKARLIGKGTTEPHP FLYKVFVRSIPANAVDFYERYLIERKFYLIGLSNEIKKGNRVDVPFIRR DQNKWKTPAMKTLGRIYDEDLPVELPRQMFDNEIKSHLKSLPQMEGI DFNNANVTYLIAEYMKRVLNDDFQTFYQWKRNYRYMDMLRGEYDR KGSLQSCFTSVEEREGLWKERASRTERYRKLASNKIRSNRQMRNASS EEIETILDKRLSNSRNEYQKSEKVIRRYRVQDALLFLLAKKTLTELADF DGERFKLKEIMPDAEKGILSEIMPMSFTFEKGGKKYTITSEGMKLKNY GDFFVLASDKRIGNLLELVGSDTVSKEDIMEEFKKYDQCRPEISSIVFN LEKWAFDTYPELSARVDREEKVDFKSILKILLNNKNINKEQSDILRKIR NAFDHNNYPDKGVVEIRALPEIAMSIKKAFGEYAIMK (SEQ ID NO: 163) |
| Prevotella sp. P5-60 | WP_044074780 | MNIPALVENQKKYFGTYSVMAMLNAQTVLDHIQKVADIEGEQNENN ENLWFHPVMSHLYNAKNGYDKQPEKTMFIIERLQSYFPFLKIMAENQ REYSNGKYKQNRVEVNSNDIFEVLKRAFGVLKMYRDLTNHYKTYEE KLIDGCEFLTSTEQPFSGMISKYYTVALRNTKERYGYKAEDLAFIQDN RYKFTKDAYGKRKSQVNTGSFLSLQDYNGDTTKKLHLSGVGIALLIC LFLDKQYINLFLSRLPIFSSYNAQSEERRIIRSFGINSIKQPKDRIHSEKS NKSVAMDMLNEVKRCPDELFTTLSAEKQSRFRIISDDHNEVLMKRSS DRFVPLLLQYIDYGKLFDHIRFHVNMGKLRYLLKADKTCIDGQTRVR VIEQPLNGFGRLEEVETMRKQENGTFGNSGIRIRDFENMKRDDANPA NYPYIVETYTHYILENNKVEMFISDEENPTPLLPVIEDDRYVVKTIPSCR MSTLEIPAMAFHMLFGSEKTEKLIIDVHDRYKRLFQAMQKEEVTAE NIASFGIAESDLPQKIMDLISGNAHGKDVDAFIRLTVDDMLTDTERRIK RFKDDRKSIRSADNKMGKRGFKQISTGKLADFLAKDIVLFQPSVNDGE NKITGLNYRIMQSAIAVDSGDDYEAKQQFKLMFEKARLIGKGTTEP HPFLYKVFVRSIPANAVDFYERYLIERKFYLIGLSNEIKKGNRVDVPFI RRDQNKWKTPAMKTLGRIYSEDLPVELPRQMFDNEIKSHLKSLPQME GIDFNNANVTYLIAEYMKRVLNDDFQTFYQWKRNYRMDMLRGEY DRKGSLQHCFTSIEEREGLWKERASRTERYRKLASNKIRSNRQMRNA SSEEIETILDKRLSNCRNEYQKSEKIIRRYRVQDALLFLLAKKTLTELA DFDGERFKLKEIMPDAEKGILSEIMPMSFTFEKGGKIYTITSGGMKLKN YGDFFVLASDKRIGNLLELVGSNTVSKEDIMEEFKKYDQCRPEISSIVF NLEKWAFDTYPELPARVDRKEKVDFWSILDVLSNNKDINNEQSYILR KIRNAFDHNNYPDKGIVEIKALPEIAMSIKKAFGEYAIMK (SEQ ID NO: 164) |
| Phaeodactylibacter xiamenensis | WP_044218239 | MTNTPKRRTLHRHPSYFGAFLNIARHNAFMIMEHLSTKYDMEDKNTL DEAQLPNAKLFGCLKKRYGKPDVTEGVSRDLRRYFPFLNYPLFHLE KQQNAEQAATYDINPEDIEFTLKGFFRLLNQMRNNYSHYISNTDYGKF DKLPVQDIYEAAIFRLLDRGKHTKRFDVFESKHTRHLESNNSEYRPRS LANSPDHENTVAFVTCLFLERKYAFPPLSRLDCFRSTNDAAEGDPLIR |

-continued

|  |  | KASHECYTMFCCRLPQPKLESSDILLDMVNELGRCPSALYNLLSEEDQ<br>ARFHIKREEITGFEEDPDEELEQEIVLKRHSDRFPYFALRYFDDTEAFQ<br>TLRFDVYLGRWRTKPVYKKRIYGQERDRVLTQSIRTFTRLSRLLPIYE<br>NVKHDAVRQNEEDGKLVNPDVTSQFHKSWIQIESDDRAFLSDRIEHFS<br>PHYNFGDQVIGLKFINPDRYAAIQNVFPKLPGEEKKDKDAKLVNETA<br>DAIISTHEIRSLFLYHYLSKKPISAGDERRFIQVDTETFIKQYIDTIKLFFE<br>DIKSGELQPIADPPNYQKNEPLPYVRGDKEKTQEERAQYRERQKEIKE<br>RRKELNTLLQNRYGLSIQYIPSRLREYLLGYKKVPYEKLALQKLRAQR<br>KEVKKRIKDIEKMRTPRVGEQATWLAEDIVFLTPPKMHTPERKTTKHP<br>QKLLNNDQFRIMQSSLAYFSVNKKAIKKFFQKETGIGLSNRETSHPFLY<br>RIDVGRCRGILDFYTGYLKYKMDWLDDAIKKVDNRKHGKKEAKKYE<br>KYLPSSIQHKTPLELDYTRLPVYLPRGLFKKAIVKALAAHADFQVEPE<br>EDNVIFCLDQLLDGTQDFYNWQRYYRSALTEKETDNQLVLAHPYA<br>EQILGTIKTLEGKQKNNKLGNKAKQKIKDELIDLKRAKRRLLDREQYL<br>RAVQAEDRALWLMIQERQKQKAEHEEIAFDQLDLKNITKILTESIDAR<br>LRIPDTKVDITDKLPLRRYGDLRRVAKDRRLVNLASYYHVAGLSEIPY<br>DLVKKELEEYDRRRVAFFEHVYQFKEVYDRYAAELRNENPKGESTY<br>FSHWEYVAVAVKHSADTHFNELFKEKVMQLRNKFHHNEFPYFDWLL<br>PEVEKASAALYADRVFDVAEGYYQKMRKLMRQ (SEQ ID NO: 165) |
| Flavobacterium<br>sp. 316 | WP_045968377 | MDNNITVEKTELGLGITYNHDKVEDKHYFGGFFNLAQNNIDLVAQEF<br>KKRLLIQGKDSINIFANYFSDQCSITNLERGIKILAEYFPVVSYIDLDEK<br>NKSKSIREHLILLLETINNLRNYYTHYYHKKIIIDGSLFPLLDTILLKVVL<br>EIKKKKLKEDTKQLLKKGLEKEMTILFNLMKAEQKEKKIKGWNIDE<br>NIKGAVLNRAFSHLLYNDELSDYRKSKYNTEDETLKDTLTESGILFLL<br>SFFLNKKEQEQLKANIKGYKGKIASIPDEEITLKNNSLRNMATHWTYS<br>HLTYKGLKHRIKTDHEKETLLVNMVDYLSKVPHEIYQNLSEQNKSLF<br>LEDINEYMRDNEENHDSSEASRVIHPVIRKRYENKFAYFAIRFLDEFAE<br>FPTLRFMVNVGNYIHDNRKKDIGGTSLITNRTIKQQINVFGNLTEIHKK<br>KNDYFEKEENKEKTLEWELFPNPSYHFQKENIPIFIDLEKSKETNDLAK<br>EYAKEKKKIFGSSRKKQQNTAKKNRETIINLVFDKYKTSDRKTVTFEQ<br>PTALLSFNELNSFLYAFLVENKTGKELEKIIIEKIANQYQILKNCSSTVD<br>KTNDNIPKSIKKIVNTTTDSFYFEGKKIDIEKLEKDITIEIEKTNEKLETI<br>KENEESAQNYKRNERNTQKRKLYRKYVFFTNEIGIEATWITNDILRFL<br>DNKENWKGYQHSELQKFISQYDNYKKEALGLLESEWNLESDAFFGQ<br>NLKRMFQSNSTFETFYKKYLDNRKNTLETYLSAIENLKTMTDVRPKV<br>LKKKWTELFRFFDKKIYLLSTIETKINELITKPINLSRGIFEEKPTFINGK<br>NPNKENNQHLFANWFIYAKKQTILQDFYNLPLEQPKAITNLKKHKYK<br>LERSINNLKIEDIYIKQMVDFLYQKLFEQSFIGSLQDLYTSKEKREIEKG<br>KAKNEQTPDESFIWKKQVEINTHNGRIIAKTKIKDIGKFKNLLTDNKIA<br>HLISYDDRIWDFSLNNDGDITKKLYSINTELESYETIRREKLLKQIQQFE<br>QFLLEQETEYSAERKHPEKFEKDCNPNFKKYIIEGVLNKIIPNHEIEEIEI<br>LKSKEDVFKINFSDILILNNDNIKKGYLLIMIRNKFAHNQLIDKNLFNFS<br>LQLYSKNENENFSEYLNKVCQNIIQEFKEKLK (SEQ ID NO: 166) |
| Porphyromonas<br>gulae | WP_046201018 | MTEQSERPYNGTYYTLEDKHFWAAFLNLARHNAYITLTHIDRQLAYS<br>KADITNDQDVLSFKALWKNFDNDLERKSRLRSLILKHFSFLEGAAYG<br>KKLFESKSSGNKSSKNKELTKKEKEELQANALSLDNLKSILFDFLQKL<br>KDFRNYYSHYRHSESSELPLFDGNMLQRLYNVFDVSVQRVKRDHEH<br>NDKVDPHRHFNHLVRKGKKDRYGHNDNPSFKHHFVDSEGMVTEAG<br>LLFFVSLFLEKRDAIWMQKKIRGFKGGTETYQQMTNEVFCRSRISLPK<br>LKLESLRTDDWMLLDMLNELVRCPKPLYDRLREKDRARFRVPVDILP<br>DEDDTDGGGEDPPFKNTLVRHQDRFPYFALRYFDLKKVFTSLRFHIDL<br>GTYHFAIYKKMIGEQPEDRHLTRNLYGFGRIQDFAEEHRPEEWKRLV<br>RDLDYFETGDKPYISQTTPHYHIEKGKIGLRFMPEGQHLWPSPEVGTT<br>RTGRSKYAQDKRLTAEAFLSVHELMPMMFYYFLLREKYSEEVSAEK<br>VQGRIKRVIEDVYAIYDAFARDEINTLKELDACLADKGIRRGHLPKQM<br>IAILSQEHKDMEEKIRKKLQEMIADTDHRLDMLDRQTDRKIRIGRKNA<br>GLPKSGVIADWLVRDMMRFQPVAKDTSGKPLNNSKANSTEYRMLQR<br>ALALFGGEKKRLTPYFRQMNLTGGNNPHPFLHETRWESHTNILSFYRS<br>YLRARKAFLERIGRSDRMENRPFLLLKEPKTDRQTLVAGWKSEFHLP<br>RGIFTEAVRDCLIEMGYDEVGSYREVGFMAKAVPLYFERACEDRVQP<br>FYDSPFNVGNSLKPKKGRFLSKEERAEEWERGKERFRDLEAWSHSAA<br>RRIEDAFAGIEYASPGNKKKIEQLLRDLSLWEAFESKLKVRADKINLA<br>KLKKKEILEAQEHPYHDFKSWQKFERELRLVKNQDIITWMMCRDLMEE<br>NKVEGLDTGTLYLKDIRPNVQEQGSLNVLNRVKPMRLPVVVYRADS<br>RGHVHKEEAPLATVYIEERDTKLLKQGNFKSFVKDRRLNGLFSFVDT<br>GGLAMEQYPISKLRVEYELAKYQTARVCVFELTLRLEESLLTRYPHLP<br>DESFRKMLESWSDPLLAKWPELHGKVRLLIAVRNAFSHNQYPMYDE<br>AVFSSIRKYDPSSPDAIEERMGLNIAHRLSEEVKQAKETVERIIQV<br>(SEQ ID NO: 167) |
| WP_047431796 | Chryseo<br>bacterium<br>sp.<br>YR477 | METQTIGHGIAYDHSKIQDKHFFGGFLNLAENNIKAVLKAFSEKFNVG<br>NVDVKQFADVSLKDNLPDNDFQKRVSFLKMYFPVVDFINIPNNRAKF<br>RSDLTTLFKSVDQLRNFYTHYYHKPLDFDASLFILLDDIFARTAKEVR<br>QKMKDDKTRQLLSKSLSEELQKGYELQLERLKELNRLGKKVNIHDQ<br>LGIKNGVLNNAFNHLIYKDGESFKTKLTYSSALTSFESAENGIEISQSG<br>LLFLLSMFLKRKEIEDLKNRNKGPFKAKVVIDEDGKVNGLKFMATHW<br>VFSYLCFKGLKSKLSTEFHEETLLIQIIDELSKVPDELYCAFDKETRDKF |

|  |  | IEDINEYVKEGHQDFSLEDAKVIHPVIRKRYENKFNYFAIRFLDEFVKF<br>PSLRFQVHVGNYVHDRRIKNIDGTTFETERVVKDRIKVFGRLSEISSYK<br>AQYLSSVSDKHDETGWEIFPNPSYVFINNNIPIHISVDTSFKKEIADFKK<br>LRRAQVPDELKIRGAEKKRKFEITQMIGSKSVLNQEEPIALLSLNEIPAL<br>LYEILINGKEPAEIERIIKDKLNERQDVIKNYNPENWLPASQISRRLRSN<br>KGERIINTDKLLQLVTKELLVTEQKLKIISDNREALKQKKEGKYIRKFI<br>FTNSELGREAIWLADDIKRFMPADVRKEWKGYQHSQLQQSLAFYNSR<br>PKEALAILESSWNLKDEKIIWNEWILKSFTQNKFFDAFYNEYLKGRKK<br>YFAFLSEHIVQYTSNAKNLQKFIKQQMPKDLFEKRHYIIEDLQTEKNKI<br>LSKPFIFPRGIFDKKPTFIKGVKVEDSPESFANWYQYGYQKDHQFQKF<br>YDWKRDYSDVFLEHLGKPFINNGDRRTLGMEELKERIIIKQDLKIKKI<br>KIQDLFLRLIAENLFQKVFKYSAKLPLSDFYLTQEERMEKENMAALQN<br>VREEGDKSPNIIKDNFIWSKMIPYKKGQIIENAVKLKDIGKLNVLSLDD<br>KVQTXLSYDDAKPWSKIALENEFSIGENSYEVIRREKLFKEIQQFESEIL<br>FRSGWDGINHPAQLEDNRNPKFKMYIVNGILRKSAGLYSQGEDIWFE<br>YNADFNNLDADVLETKSELVQLAFLVTAIRNKFAHNQLPAKEFYFYIR<br>AKYGFADEPSVALVYLNFTKYAINEFKKVMI (SEQ ID NO: 168) |
| Riemerella<br>anatipestifer | WP_049354263 | MFFSFHNAQRVIFKHLYKAFDASLRMVKEDYKAHFTVNLTRDFAHL<br>NRKGKNKQDNPDFNRYRFEKDGFFTESGLLFFTNLFLDKRDAYWML<br>KKVSGFKASHQREKMTTEVFCRSRILLPKLRLESRYDHNQMLLDML<br>SELSRCPKLLYEKLSEENKKHFQVEADGFLDEIEEEQNPFKDTLIRHQD<br>RPFPYFALRYLDLNESFKSIRFQVDLGTYHYCIYDKKIGDEQEKRHLTR<br>TLLSFGRLQDFTEINRPQEWKALTKDLDYKETSNQPFISKTTPHYHITD<br>NKIGFRLGTSKELYPSLEIKDGANRIAKYPYNSGFVAHAFISVHELLPL<br>MFYQHLTGKSEDLLKETVRHIQRIYKDFEEERINTIEDLEKANQGRLPL<br>GAFPKQMLGLLQNKQPDLSEKAKIKIEKLIAETKLLSHRLNTKLKSSP<br>KLGKRREKLIKTGVLADWLVKDFMRFQPVAYDAQNQPIKSSKANSTE<br>FWFIRRALALYGGEKNRLEGYFKQTNLIGNTNPHPFLNKFNWKACRN<br>LVDPFYQQYLEQREKFLEAIKNQPWEPYQYCLLLKIPKENRKNLVKGW<br>EQGGISLPRGLFTEAIRETLSEDLMLSKPIRKEIKKHGRVGFISRAITLYF<br>KEKYQDKHQSFYNLSYKLEAKAPLLKREEHYEYWQQNKPQSPTESQ<br>RLELHTSDRWKDYLLYKRWQHLEKKLRLYRNQDVMLWLMTLELTK<br>NHFKELNLNYHQLKLENLAVNVQEADAKLNPLNQTLPMYLPVKVYP<br>ATAFGEVQYHKTPIRTVYIREEHTKALKMGNFKALVKDRRLNGLFSFI<br>KEENDTQKHPISQLRLRRELEIYQSLRVDAFKETLSLEEKLLNKHTSLS<br>SLENEFRALLEEWKKEYAASSMVTDEHIAFIASVRNAFCHNQYPFYKE<br>ALHAPIPLFTVAQPTTEEKDGLGIAEALLKVLREYCEIVKSQI<br>(SEQ ID NO: 169) |
| Porphyromonas<br>gingivalis | WP_052912312 | MTEQNEKPYNGTYYTLEDKHFWAAFFNLARHNAYITLAHIDRQLAYS<br>KADITNDEDILFFKGQWKNLDNDLERKARLRSLILKHFSFLEGAAYGK<br>KLFESQSSGNKSSKKKELTKKEKEELQANALSLDNLKSILFDFLQKLK<br>DFRNYYSHYRHPESSELPLFDGNMLQRLYNVFDVSVQRVKRDHEHN<br>DKVDPHRHFNHLVRKGKKDKYGNNDNPFFKHHFVDREEKVTEAGLL<br>FFVSLFLEKRDAIWMQKKIRGFKGGTEAYQQMTNEVFCRSRISLPKLK<br>LESLRTDDWMLLDMLNELVRCPKLLYDRLREEDRARFRVPVDILSDE<br>DDTDGTEEDPFKNTLVRHQDRFPYFALRYFDLKKVFTSLRFHIDLGTY<br>HFAIYKKNIGEQPEDRHLTRNLYGFGRIQDFAEEHRPEEWKRLVRDLD<br>YFETGDKPYITQTTPHYHIEKGKIGLRFVPEGQLLWPSPEVGATRTGRS<br>KYAQDKRFTAEAFLSVHELMPMMFYYFLLREKYSEEEASAEKVQGRIK<br>RVIEDVYAVYDAFARDEINTRDELDACLADKGIRRGHLPRQMIAILSQ<br>EHKDMEEKVRKKLQEMIADTDHRLDMLDRQTDRKIRIGRKNAGLPK<br>SGVIADWLVRDMMRFQPVAKDTSGKPLNNSKANSTEYRMLQRALAL<br>FGGEKERLTPYFRQMNLTGGNNPHPFLHETRWESHTNILSFYRSYLKA<br>RKAFLQSIGRSDREENHRFLLLKEPKTDRQTLVAGWKSEFHLPRGIFT<br>EAVRDCLIEMGYDEVGSYKEVGFMAKAVPLYFERACKDRVQPFYDY<br>PFNVGNSLKPKKGRFLSKEKRAEEWESGKERFRDLEAWSHSAARRIE<br>DAFVGIEYASWENKKKIEQLLQDSLWETFESKLKVKADKINIAKLKK<br>EILEAKEHPYHDFKSWQKFERELRLYKNQDIITWMMCRDLMEENKVE<br>GLDTGTLYLKDIRTDVQEOGSLNVLNHVKPMRLPVVVYRADSRGHV<br>HKEEAPLAIYYIEERDTKLLKQGNFKSFVKDRRLNGLFSFVDTGALA<br>MEQYPISKLRVEYELAKYQTARVCAFEQTLELEESLLTRYPFILPDESF<br>REMLESWSDPLLDKWPDLQREVRLLIAVRNAFSHNQYPMYDETIFSSI<br>RKYDPSSLDAIEERMGLNIAHRLSEEVKLAKEMVERIIQA (SEQ ID<br>NO: 170) |
| Porphyromonas<br>gingivalis | WP_058019250 | MTEQNEKPYNGTYYTLKDKHFWAAFFNLARHNAYITLTHIDRQLAYS<br>KADITNDEDILFFKGQWKNLDNDLERKARLRSLILKHFSFLEGAAYGK<br>KLFESQSSGNKSSKKKELTKKEKEELQANALSLDNLKSILFDFLQKLK<br>DFRNYYSHYRHPESSELPMFDGNMLQRLYNVFDVSVQRVKRDHEHN<br>DKVDPHRHFNHLVRKGKKDRCGNNDNPFFKHHFVDREGKVTEAGLL<br>FFVSLFLEKRDAIWMQKKIRGFKGGTETYQQMTNEVFCRSRISLPKLK<br>LESLRTDDWMLLDMLNELVRCPKSLYDRLREEDRACFRVPVDILSDE<br>DDTDGAEEDPFKNTLVRHQDRFPYFALRYFDLKKVFTSLRFHIDLGTY<br>HFAIYKKNIGEQPEDRHLTRNLYGFGRIQDFAEEHRPEEWKRLVRDLD<br>CFETGDKPYTTQTTPHYHIEKGKIGLRFVPEGQHLWPSPEVGATRTGRS<br>KYAQDKRFTAEAFLSVHELMPMMFYYFLLREKYSEEVSAERVQGRIK<br>RVIEDVYAVYDAFARDEINTRDELDACLADKGIRRGHLPRQMIAILSQ |

| | | |
|---|---|---|
| | | KHKDMEEKVRKKLQEMIADTDHRLDMLDRQTDRKIRIGRKNAGLPK SGVIADWLVRDMMRFQPVAKDTSGKPLNNSKANSTEYRMLQRALAL FGGEKERLTPYFRQMNLTGGNNPHPFLHETRWESHTNILSFYRSYLKA RKAFLQSIGRSDRVENHRFLLLKEPKTDRQTLVAGWKGEFHLPRGIFT EAVRDCLIEMGLDEVGSYKEVGFMAKAVPLYFERACKDRVOPFYDY PFNVGNSLKPKKGRFLSKEKRAEEWESGKERFRDLEAWSHSAARRIE DAFAGIENASRENKKKIEQLLQDLSLWETFESKLKVKADKINIAKLKK EILEAKEHPYLDFKSWQKFERELRLVKNQDIITWMMCRDLMEENKVE GLDTGTLYLKDIRTDVQEQGSLNVLNHVKPMRLPVVVYRADSRGHV HKEQAPLATVYIEERDTKLLKQGNFKSFVKDRRLNGLFSFVDTGALA MEQYPISKLRVEYELAKYQTARVCAFEQTLELEESLLTRYPHLPDENF RKMLESWSDPLLDKWPDLHRKVRLLIAVRNAFSHNQYPMYDEAVFS SIRKYDPSSPDAIEERMGLNIAHRLSEEVKQAKEMAERIIQA (SEQ ID NO: 171) |
| *Flavobacterium columnare* | WP_060381855 | MSSKNESYNKQKTFNHYKQEDKYFFGGFLNNADDNLRQVGKEFKTR INFNHNNNELASVFKDYFNKEKSVAKREHALNLLSNYFPVLERIQKHT NHNFEQTREIFELLLDTIKKLRDYYTHHYHKPITINPKVYDFLDDTLLD VLITIKKKKVKNDTSRELLKEKFRPELTQLKNQKREELIKKGKKLLEE NLENAVFNHCLRPFLEENKTDDKQNKTVSLRKYRKSKPNEETSITLTQ SGLVFLISFFLHRKEFQVFTSGLEGFKAKVNTIKEEEISLNKNNIVYMIT HWSYSYYNFKGLKHRIKTDQGVSTLEQNNTTHSLTNTNTKEALLTQI VDYLSKVPNEIYETLSEKQQKEFEEDINEYMRENPENEDSTFSSIVSHK VIRKRYENKFNYFAMRFLDEYAELPTLRFMVNFGDYIKDRQKKILESI QFDSERIIKKEIHLFEKLGLVTEYKKNVYLKETSNIDLSRFPLFPSPSYV MANNNIPFYIDSRSNNLDEYLNQKKAQSQNRKRNLTFEKYNKEQSK DAIIAMLQKEIGVKDLQQRSTIGLLSCNELPSMLYEVIVKDIKGAELEN KIAQKIREQYQSIRDFTLDSPQKDNIPTTLTKTISTDTSVTFENQPIDIPR LKNALQKELTLTQEKLLNVKQHEIEVDNYNRNKNTYKFKNQPKDKV DDNKLQRKYVFYRNEIGQEANWLASDLIHFMKNKSLWKGYMHNEL QSFLAFFEDKKNDCIALLETVFNLKEDCILTKDLKNLFLKHGNFIDFYK EYLKLKEDPLNTESTFLENGFIGLPPKILKKELSKRLNYIFIVFQKRQFII KELEEKKNNLYADAINLSRGIFDEKPTMIPFKKPNPDEFASWFVASYQ YNNYQSFYELTPDKIENDKKKKYKNLRAINKVKIQDYYLKLMVDTLY QDLFNQPLDKSLSDFYVSKTDREKTKADAKAYQKRNDSFLWNKVIHL SLQNNRITANPKLKDIGKYKRALQDEKIATLLTYDDRTWTYALQKPE KENENDYKELHYTALNMELOEYEKVRSKKLLKQVQELEKQILDKFY DFSNNATHPEDLEIEDKKGKRHPNFKLYITKALLKNESEIINLENIDIEIL IKYYDYNTEKLKEKIKNMDEDEKAKIVNTKENYNKITNVLIKKALVLI IIRNKMAHNQYPPKFRYDLATRFVPKKEEEYFACYFNRVFETITTELWE NKKKAKEIV (SEQ ID NO: 172) |
| *Porphyromonas gingivalis* | WP_061156470 | MTEQNERPYNGTYYTLEDKHFWAAFFNLARHNAYITLTHIDRQLAYS KADITNDEDILFFKGQWKNLDNDLERKARLRSLILKHFSFLEGAAYGK KLFENKSSGNKSSKKKELTKKEKEELQANALSLDNLKSILFDFLQKLK DFRNYYSHYRHPESSELPLFDGNMLQRLYNVFDVSVQRVKRDHEHN DKVDPHRHFNHLVRKGKKDRCGNNDNPFFKHHFVDREGKVTEAGLL FFVSLFLEKRDAIWMQKKIRGFKGGTEAYQQMTNEVFCRSRISLPKLK LESLRTDDWMLLDMLNELVRCPKSLYDRLREEDRARFRVPVDILSDE DDTDGTEEDPFKNTLVRHQDRFPYFALRYFDLKKVFTSLRFHIDLGTY HFAIYKKNIGEQPEDRHLTRNLYGFGRIQDFAEEHRPEEWKRLVRDLD YFETGDKPYITQTTPHYHIEKGKIGLRFVPEGQHLWPSPEVGATRTGR SKYAQDKRLTAEAFLSVHELMPMMFYYFLLREKYSEEVSAEKVQGRI KRVIEDVYAVYDAFARGEIDTLDRLDACLADKGIRRGHLPRQMIAILS QEHKDMEEKVRKKLQEMIADTDHRLDMLDRQTDRKIRIGRKNAGLP KSGVIADWLVRDMMRFQPVAKDTSGKPLNNSKANSTEYRMLQRALA LFGGEKERLTPYFRQMNLTGGNNPHPFLHETRWESHTNILSFYRSYLK ARKAFLQSIGRSDREENHRFLLLKEPKTDRQTLVAGWKSEFHLPRGIF TEAVRDCLIEMGYDEVGSYKEVGFMAKAVPLYFERACKDRVQPFYD YPFNVGNSLKPKKGRFLSKEKRAEEWESGKERFRLAKLKKEILEAKE HPYLDFKSWQKFERELRLVKNQDIRRWMMCRDLMEENKVEGLDTGT LYLKDIRTEVQEQGSLNVLNRVKPMRLPVVVYRADSRGHVHKEQAP LATVYIEERDTKLLKQGNFKSFVKDRRLNGLFSFVDTGGLAMEQYPIS KLRVEYELAKYQTARVCAFEQTLELEESLLTRCPHLPDKNFRKMLES WSDPLLDKWPDLQREVWLLIAVRNAFSHNQYPMYDEAVFSSIRKYDP SSPDAEERMGLNIAHRLSEEVKQAKEMAERIIQA (SEQ ID NO: 173) |
| *Porphyromonas gingivalis* | WP_061156637 | MNTVPASENKGQSRTVEDDPQYFGLYLNLARENLIEVESHVRIKFGK KKLNEESLKQSLLCDHLLSVDRWTKVYGHSRRYLPFLHYFDPDSQIE KDHDSKTGVDPDSAQRLIRELYSLLDFLRNDFSHNRLDGTTFEHLEVS PDISSFITGTYSLACGRAQSRFADFFKPDDFVLAKNRKEQLISVADGKE CLTVSGLAFFICLFLDREQASGMLSRIRGFKRTDENWARAVHETFCDL CIRHPHDRLESSNTKEALLLDMLNELNRCPRILYDMLPEEERAQFLPA LDENSMNNLSENSLNEESRLLWDGSSDWAEALTKRIRHQDRFPYLML RFIEEMDLLKGIRFRVDLGEIELDSYSKKVGRNGEYDRTITDHALAFG KLSDFQNEEEVSRMTSGEASYPVRFSLFAPRYTAIYDNKIGYCHTSDPVY PKSKTGEKRALSNPQSMGFISVHDLRKLLLMELLCEGSFSRMQSGFLR KANRILDETAFGKLQFSALFPEMRHRFIPPQNPKSKDRREKAETTLEK YKQEIKGRKDKLNSQLLSAFDMNQRQLPSRLLDEWMNIRPASHSVKL |

| | | |
|---|---|---|
| | | RTYVKQLNEDCRLRLRKFRKDGDGKARAIPLVGEMATFLSQDIVRMII<br>SEETKKLITSAYYNEMQRSLAQYAGEENRRQFRAIVAELHLLDPSSGH<br>PFLSATMETAHRYTEDFYKCYLEKKREWLAKTFYRPEQDENTKRRIS<br>VFFVPDGEARKLLPLLIRRRMKEQNDLQDWIRNKQAHPIDLPSHLFDS<br>KIMELLKVKDGKKKWNEAFKDWWSTKYPDGMQPFYGLRRELNIHG<br>KSVSYIPSDGKKFADCYTHLMEKTVQDKKRELRTAGKPVPPDLAADI<br>KRSFHRAVNEREFMLRLVQEDDRLMLMAINKMMTDREEDILPGLKNI<br>DSILDKENQFSLAVHAKVLEKEGEGGDNSLSLVPATIEIKSKRKDWSK<br>YIRYRYDRRVPGLMSHFPEHKATLDEVKTLLGEYDRCRIKIFDWAFAL<br>EGAIMSDRDLKPYLHESSSREGKSGEHSTLVKMLVEKKGCLTPDESQ<br>YLILIRNKAAHNQFPCAAEMPLIYRDVSAKVGSIEGSSAKDLPEGSSLV<br>DSLWKKYEMIIRKILPILDPENRFFGKLLNNMSQPINDL<br>(SEQ ID NO: 174) |
| *Riemerella*<br>*anatipestifer* | WP_061710138 | MFFSFHNAQRVIFKHLYKAFDASLRMVKEDYKAHFTVNLTRDFAHL<br>NRKGKNKQDNPDFNRYRFEKDGFFTESGLLFFTNLFLDKRDAYWML<br>KKVSGFKASHKQSEKMTTEVFCRSRILLPKLRLESRYDHNQMLLDML<br>SELSRCPKLLYEKLSEKDKKCFQVEADGFLDEIEEEQNPFKDTLIRHQD<br>RFPYFALRYLDLNESFKSIRFQVDLGTYHYCIYDKKIGYTEQEKRHLTR<br>TLLNFGRLQDFTEINRPQEWKALTKDLDYNETSNQPFISKTTPHYITD<br>NKIGFRLRTSKELYPSLEVKDGANRIAKYPYNSDFVAHAFISISVHELL<br>PLMFYQHLTGKSEDLLKETVRHIQRIYKDFEEERINTIEDLEKANQGRL<br>PLGAFPKQMLGLLQNKQPDLSEKAKIKIEKLIAETKLLSHRLNTKLKSS<br>PKLGKRREKLIKTGVLADWLVKDFMRFQPVVYDAQNQPIKSSKANST<br>ESRLIRRALALYGGEKNRLEGYFKQTNLIGNTNPHPFLNKFNWKACR<br>NLVDFYQQYLEQREKFLEAIKHQPWEPYQYCLLLKVPKENRKNLVK<br>GWEQGGISLPRGLFTEAIRETLSKDLTLSKPIRKEIKKHGRVGFISRAIT<br>LYFKEKYQDKHQSFYNLSYKLEAKAPLLKKEEHYEYWQQNKPQSPT<br>ESQRLELHTSDRWKDYLLYKRWQHLEKKLRLYRNQDIMLWLMTLEL<br>TKNHFKELNLNYHQLKLENLAVNVQEADAKLNPLNQTLPMVLPVKV<br>YPTTAFGEVQYHETPIRTVYIREEQTKALKMGNFKALVKDRHLNGLF<br>SFIKEENDTQKHPISQLRLRRELEIYQSLRVDAFKETLSLEEKLLNKHA<br>SLSSLENEFRTLLEEWKKKYAASSMVTDKHLAFIASVRNAFCFLNQYPF<br>YKETLFIAPILLFTVAQPTTEEKDGLGIAEALLRVLREYCEIVKSQI<br>(SEQ ID NO: 175) |
| *Flavobacterium*<br>*columnare* | WP_063744070 | MSSKNESYNKQKTFNHYKQEDKYFFGGFLNNADDNLRQVGKEFKTR<br>INFNHNNNELASVFKDYFNKEKSVAKREHALNLLSNYFPVLERIQKHT<br>NHNFEQTREIFELLLDTIKKLRDYYTHHYHKPITINPKIYDFLDDTLLD<br>VLITIKKKKVKNDTSRELLKEKLRPELTQLKNQKREELIKKGKKLLEE<br>NLENAVFNHCLRPFLEENKTDDKQNKTVSLRKYRKSKPNEETSITLTQ<br>SGILVFLMSFFLHRKEFQVFTSGLEGFKAKVNTIKEEKISLNKNNIVYMI<br>THWSYSYYNFKGLKHRIKTDQGVSTLEQNNTTHSLTNTNTKEALLTQ<br>IVDYLSKVPNEIYETLSEKQQKEFEEDINEYMRENPENEDSTFSSIVSH<br>KVIRKRYENKFNYFAMRFLDEYAELPTLRFMVNFGDYIKDRQKKILES<br>IQFDSERIIKKEIHLFEKLGLVTEYKKNVYLKETSNIDLSRFPLFPSPSYV<br>MANNNIPFYIDSRSNNLDEYLNQKKKAQSQNRKRNLTFEKYNKEOSK<br>DAIIAMLQKEIGVKDLQQRSTIGLLSCNELPSMLYEVIVKDIKGAELEN<br>KIAQKIREQYQSIRDFTLNSPQKDNIPTTLIKTISTDTSVTFENQPIDIPRL<br>KNAIQKELALTQEKLLNVKQHEIEVNNYNRNKNTYKFKNQPKDKVD<br>DNKLQRKYVFYRNEIGQEANWLASDLIHFMKNKSLWKGYMHNELQS<br>FLAFFEDKKNDCIALLETVFNLKEDCILTKDLKNLFLKHGNFIDFYKEY<br>LKLKEDFLNTESTFLENGFIGLPPKILKKELSKRLNYIFIVFQKRQFIIKE<br>LEEKKNNLYADAINLSRGIFDEKPTMIPFKKPNPDEFASWFVASYQYN<br>NYQSFYELTPDKIENDKKKKYKNLRAINKVKIQDYYLKLMVDTLYQD<br>LFNQPLDKSLSDFYVSKTDREKIKADAKAYQKRNDSFLWNKVIHLSL<br>QNNRITANPKLKDIGKYKRALQDEKIATLLTYDDRTWTYALQKPEKE<br>NENDYKELHYTALNMELQEYEKVRSKKLLKQVQELEKQILDKFYDFS<br>NNATHPEDLEIEDKKGKRHPNFKLYITKALLKNESEIINLENIDIEILIKY<br>YDYNTEKLKEKIKNMDEDEKAKIVNTKENYNKITNVLIKKALVLIIIR<br>NKMAHNQYPPKFIYDLATRFVPKKEEEYFACYFNRVFETITTELWEN<br>KKKAKEIV (SEQ ID NO: 176) |
| *Riemerella*<br>*anatipestifer* | WP_064970887 | MEKPLPPNVYTLKHKFFWGAFLNIARHNAFITICHINEQLGLTTPPNDD<br>KIADVVCGTWNNILNNDHDLLKKSQLTELILKHFPPFLAAMCYHPPKK<br>EGKKKGSQKEQQKEKENEAQSQAEALNPSELIKVLKTLVKQLRTLRN<br>YYSHHSHKKPDAEKDIFKHLYKAFDASLRMVKEDYKAHFTVNLTQD<br>FAHLNRKGKNKQDNPDFDRYRFEKDGFFTESGLLFFTNLFLDKRDAY<br>WMLKKVSGFKASHKQSEKMTTEVFCRSRILLPKLRLESRYDHNQMLL |

|  |  |  |
|---|---|---|
| | | DMLSELSRYPKLLYEKLSEEDKKRFQVEADGFLDEIEEEQNPFKDTLIR
HQDRFPYFALRYLDLNESFKSIRFQVDLGTYHYCIYDKKIGDEQEKRH
LTRTLLSFGRLQDFTEINRPQEWKALTKDLDYKETSKQPFISKTTPHYH
ITDNKIGFRLGTSKELYPSLEVKDGANRIAQYPYNSDFVAHAFISVHEL
LPLMFYQHLTGKSEDLLKETVRHIQRIYKDFEEERINTIEDLEKANQGR
LPLGAFPKQMLGLLQNKQPDLSEKAKIKIEKLIAETKLLSHRLNTKLKS
SPKLGKRREKLIKTGVLADWLVKDFMRFQPVAYDAQNQPIESSKANS
TEFQLIQRALALYGGEKNRLEGYFKQTNLIGNTNPHPFLNKFNWKAC
RNLVDFYQQYLEQREKFLEAIKNQPWEPYQYCLLLKIPKENRKNLVK
GWEQGGISLPRGLFTEAIRETLSKDLTLSKPIRKEIKKHGRVGFISRAIT
LYFREKYQDDHQSFYDLPYKLEKASPLPKKEHYEYWQQNKPQSPTE
LQRLELHTSDRWKDYLLYKRWQHLEKKLRLYRNQDVMLWLMTLEL
TKNHFKELNLNYHQLKLENLAVNVQEADAKLNPLNQTLPMVLPVKV
YPATAFGEVQYQETPIRTVYIREEQTKALKMGNFKALVKDRRLNGLF
SFIKEENDTQKHPISQLRLRRELEIYQSLRVDAFKETLNLEEKLLKKHT
SLSSVENKFRILLEEWKKEYAASSMVTDEHIAFIASVRNAFCHNQYPF
YEEALHAPIPLFTVAQQTTEEKDGLGIAEALLRVLREYCEIVKSQI
(SEQ ID NO: 177) |
| Sinomicrobium
oceani | WP_072319476.1 | MESTTTLGLHLKYQHDLFEDKHYTGGGVNLAVQNIESIFQAFAERYGT
QNPLRKNGVPAINNIFHDNISISNYKEYLKFLKQYLPVVGFLEKSNEINI
FEFREDFEILINAIYKLRHFYTHYYHSPIKLEDRFYTCLNELFVAVAIQV
KKHKMKSDKTRQLLNKNLHQLLQQLIEQKREKLKDKKAEGEKVSLD
TKSIENAVLNDAFVFHLLDKDENIRLNYSSRLSEDIITKNGITLSISGLLFL
LSLFLQRKEAEDLRSRIEGFKGKGNELRFMATHWVFSYLNVKRIKHR
LNTDFQKETLLIQIADELSKVPDEVYKTLDHENRSKFLEDINEYIREGN
EDASLNESTVVHGVIRKRYENKFHYLVLRYLDEFVDFPSLRFQVHLG
NYIHDRRDKVIDGTNFITNRVIKEPIKVFGKLSHVSKLKSDYMESLSRE
HKNGWDVFPNPSYNFVGHNIPIFINLRSASSKGKELYRDLMKIKSEKK
KKSREEGIPMERRDGKPTKIEISNQIDRNIKDNNFKDIYPGEPLAMLSL
NELPALLFELLRRPSITPQDIEDRMVEKLYERFQIIRDYKPGDGLSTSKI
SKKLRKADNSTRLDGKKLLRAIQTETRNAREKLHTLEENKALQKNRK
RRTVYTTREQGREASWLAQDLKRFMPIASRKEWRGYHHSQLQQILAF
YDQNPKQPLELLEQFWDLKEDTYVWNSWIHKSLSQHNGFVPMYEGY
LKGRLGYYKKLESDIIGFLEEHKVLKRYYTQQHLNVIFRERLYFIKTET
KQKLELLARPLVFPRGIFDDKPTFVQDKKVVDHPELFADWYVYSYKD
DHSFQEFYHYKRDYNEIFETELSWDIDFKDNKRQLNPSEQMDLFRMK
WDLKIKKIKIQDIFLKIVAEDIYLKIFGHKIPLSLSDFYISRQERLTLDEQ
AVAQSMRLPGDTSENQIKESNLWQTTVPYEKEQIREPKIKLKDIGKFK
YFLQQQKVLNLLKYDPQHVWTKAELEEELYIGKHSYEVVRREMLLQ
KCHQLEKHILEQRFDGSNHPRELEQGNHPNFKMYIVNGILTKRGELE
IEAENWWLELGNSKNSLDKVEVELLTMKTIPEQKAFLLILIRNKFAHN
QLPADNYFHYASNLMNLKKSDTYSLFWFTVADTIVQEFMSL
(SEQ ID NO: 178) |
| Reichenbachiella
agariperforans | WP_073124441.1 | MKTNPLIASSGEKPNYKKFNTESDKSFKKIFQNKGSIAPIAEKACKNFE
IKSKSPVNRDGRLHYFSVGHAFKNIDSKNVFRYELDESQMDMKPTQF
LALQKEFFDFQGALNGLLKHIRNVNSHYVHTFEKLEIQSINQKLITFLIE
AFELAVIHSYLNEEELSYEAYKDDPQSGQKLVQFLCDKFYPNKEHEV
EERKTILAKNKRQALEHLLFIEVTSDIDWKLFEKHKVFTISNGKYLSFH
ACLFLLSLFLYKSEANQLISKIKGFKRNDDNQYRSKRQIFTFFSKKFTS
QDVNSEEQFILVKFRDVIQYLNHYPSAWNKHLELKSGYPQMTDKLMR
YIVEAEIYRSFPDQTDNHRFLLFAIREFFGQSCLDTWTGNTPINFSNQE
QKGFSYEINTSAEIKDIETKLKALVLKGPLNFKEKKEQNRLEKDLRRE
KKEQPTNRVKEKLLTRIQHNMLYVSYGRNQDRFMDFAARFLAETDY
FGKDAKFKMYQFYTSDEQRDHLKEQKKELPKKEFEKLKYHQSKLVD
YFTYAEQQARYPDWDTPFVVENNAIQIKVTLFNGAKKIVSVQRNLML
YLLEDALYSEKRENAGKGLISGYFVHHQKELKDQLDILEKETEISREQ
KREFKKLLPKRLLHRYSPAQINDTTEWNPMEVILEEAKAQEORYQLL
LEKAILHQTEEDFLKRNKGKQFKLRFVRKAWHLMYLKELYMNKVAE
HGHHKSFHITKEEFNDFCRWMFAFDEVPKYKEYLCDYFSQKGFFNNA
EFKDLIESSTSLNDLYEKTKQRFEGWSKDLTKQSDENKYLLANYESM
LKDDMLYVNISHFISYLESKGKINRNAHGHIAYKALNNVPFSLIEEYYY
KDRLAPEEYKSHGKLYNKLKTVKLEDALLYEMAMHYLSLEPALVPK
VKTKVKDILSSNIAFDIKDAAGHHLYHLLIPFHKIDSFVALINHQSQQE
KDPDKTSFLAKIQPYLEVKNSKDLKAVYHYYKDTPHTLRYEDLNMI
HSHIVSQSVQFTKVALKLEEYFIAKKSITLQIARQISYSEIADLSNYFTD
EVRNTAFHFDVPETAYSMILQGIESEFLDREIKPQKPKSLSELSTQQVS
VCTAFLETLHNNLFDRKDDKKERLSKARERYFEQIN (SEQ ID NO: 179) |

Example 28: Identification of C2c2 Orthologs

To improve or otherwise alter the properties of the C2c2 enzyme, modifications of amino acids are implemented. The changeable residues are identified as a subset of the conserved charged residues. These residues have >80% conservation in the alignment of FIG. 53. These can be changed to an uncharged residue (typically an alanine). One or more of the indicated residue is mutated. Amino acid residue numbering corresponds to the consensus numbering as indicated in FIG. 66 (top line), and reproduced below:

```
(SEQ ID NO: 180)
MWISIKTLIHHLGVLFFCDMGNLFGHMKIXKVXHEKRXAKXKXPXKKVXV

KRKYSGGGLLLNYNENPNKNKSXENILIKKKTSFXXLKSSSKLBKTINKP

DXKKKXXXXLQWFLSEIVKKINRRNGLVLSDMLSVDKRXXEKIXEKXXXLK

YFXXXXXXLXKLHQEKPSKKLFNLKDLKEXEEXVLFLKXKFKNEJXYXXE

NDXXKDIEKILXEXLRXGFXPADKKLXKFLIEXXWGIFSXXXKLEPYXI

QEDFXEXYIEDFKKLNKXKXJXKSIENNKIVSQKSSDSQIYEXGKNIIMS

XXGXIESIIEXXSKRKXXLDKYATXXLXEKLLLDEXLXIEQXXXNXXEXX

DKLASNLKXYXLXKLYFYVKXDKKKSXXEVAKAAVSAAKDXNKDKYQNEW

XXHEXRKEDKRDFIXXXLETXXIXKXIXKVKXXIXKXAXXEAXEXIKXXN

IGKYRXXJDLFELEEDNXLNQFXXFVNIEXXKFFXHYXPNXIKRIXXXKN

DAXAXXLKXGELXKKVEKQLKNGALSIYXIXXGKAVYYXXFAMKXLADSD

YWTXKDLEXIKISEAFLRKFIGACSFAYXSLXAXNILQPECXXDILGKGD

LLXKATVNIXQXXSEHIMYLGKLREINDIDXLLXFKEDIAKSTXKXGXGX

LXKNLTQFFGGESTWDNKIFXAAYXXXLXGXXENEDFLGWALRGAIXSIR

NEXFHSFKIKKHXXXXFLNIXNFIXXKLXEFEKXXXXKXKEXXHXXXTSY

XXXLIKKLFXNEXXKXXLPXXIKELKLKSSGVXMYYSXDDLKKLLENIYF

KFSLLKIXEENXEXAXFVPSFKKVYXRADGVKGFDYQXXXTRXHAYXLKL

XPFFDXEEXEXEAFNARYYLLKXIYYNXILEXXXEENEXXXXFLPKFXXX

NNXAFREXXNFXADXIEXYYKRLQINKKKGAXKXXKKKXQXKVXNXYNRK

XFAYAFENIRXMXFXETPREYMQYIQSEYXIENNGKEXKKSXXENKRNKD

XFXHXEKFLLQVFIKGFDXYJDXRXENFXFILXPEPQNGTKEYLYEEXXA

ILDEXXXXNXLRXXXITXNKXLKLXEFJPEXXKSDIKVXPXLVEEIYDYIK

KIKINKIKKDXEJAFWQDAALYLFCEKLLDARHLSXXLRXELIKYKQFXK

DIKXRAXXNGNXINHSXXXNXXXVXECTDELEIIELXLLLNDRXSNDFKD

YFDDEEAXIXXXXLCRIIFYAEYLXKYXKEEDDXXXXAEXXXFXALEPFC

QSDTAREAKNDIYXDGGXNPELRVPILNRGIXQXKKIYGIEXXLEKLFDK

NXLFBIDGXBIPXFKVSEEXAIIXEXXEKKXEIXEXSQYKXRGELHTEWX

QKAREIEEYXXXXXKXFXKKPQNXXFEKRFIEKHGQEYKKAXXXIXEYX

WLKNKVEXNXLNELHELLIXLLGRLIGYSALFERDLQYFXNGFHYXCLNN

DXEKLAXYXNJSXVXXKNRXIXKAXLYQIFAMYXXGLPFYSKDXDXXXAX

XSGXKXSXXXXSXXTAGXGKKJKKFKKYSXYXLIXXXLXXDXSKKLDXYL

AGLELFENXEEHDNXTEXIRNYIAHFNYLXXAGXXADXSLLELYNXLRDR

LXSYDRKLKNAVSKSLIDILDRHGMILKFKFKXXXKLIGXNDXXXXAIKH

KDXARITIXEPNGVTSEXFTYKLLXXVAALEIXSLEPKKIRHLXXXARLL

YYPKXATAQSQPDQKXXXXKXKKKNIXKGYIERXTNQVSSNQEEYCELVKK

LLETXXLXXLAVXGVAXBIGLHISRLRRIREDAIIVGRRYRFRVEIYVPP

KSNTSKLNAADLVRID
```

Mutated residues based on consensus sequence using MUSCLE alignment (www.ebi.ac.uk/Tools/msa/muscle/). Corresponding positions in Lsh indicated

| consensus | Lsh | consensus | Lsh |
|---|---|---|---|
| K28 | R9 | E839 | K1134 |
| K31 | E12 | R885 | K1187 |
| R44 | R29 | E894 | E1196 |
| E162 | E154 | R895 | R1197 |
| E184 | E179 | D896 | D1198 |
| K262 | R362 | K942 | K1254 |
| E288 | K353 | R960 (HEPN) | R1278 |
| K357 | K429 | H965 (HEPN) | H1283 |
| E360 | Y432 | D990 | S1310 |
| K338 | K405 | K992 | R1312 |
| R441 (HEPN) | K558 | K994 | N1314 |
| H446 (HEPN) | N563 | | |
| E471 | D616 | | |
| K482 | K628 | | |
| K525 | E679 | | |
| K558 | K711 | | |
| D707 | D943 | | |
| R790 | I1067 | | |
| K811 | K1103 | | |
| R833 | K1128 | | |

C2c2 proteins having any one or more of the above amino acid residues, alone, or in combination, mutated display altered specificity and/or activity and/or alternative PAM recognition.

Example 29

Based on the alignment of Lw2 and FSL (FIG. 67), the following conserved residues were identified:

| | | | | | |
|---|---|---|---|---|---|
| M35 | K198 | I478 | A593 | R717 | F825 |
| K36 | N201 | E479 | L597 | H722 | Y829 |
| T38 | Y222 | K494 | I601 | F740 | K831 |
| K39 | D253 | R495 | L602 | F742 | D837 |
| I57 | I266 | N498 | E611 | K768 | L852 |
| E65 | F267 | S501 | E613 | I774 | F858 |
| G66 | S280 | E519 | D630 | K778 | E867 |
| L68 | I303 | N524 | I631 | I783 | A871 |
| N84 | N306 | Y529 | G633 | L787 | L875 |
| T86 | R331 | V530 | K641 | S789 | K877 |
| E88 | Y338 | G534 | N646 | V792 | Y880 |
| I103 | K389 | K535 | V669 | Y796 | Y881 |
| N105 | Y390 | Y539 | F676 | D799 | F884 |
| E123 | K391 | T549 | S678 | F812 | F888 |
| R128 | I434 | D551 | N695 | N818 | F896 |
| R129 | K435 | R577 | E703 | P820 | N901 |
| K139 | L458 | E580 | A707 | F821 | V903 |
| L152 | D459 | A581 | I709 | V822 | N915 |
| L194 | E462 | F582 | I713 | P823 | K916 |
| N196 | L463 | I587 | I716 | S824 | R918 |
| Q920 | I1075 | K1243 | K1341 | K1466 | A1550 | V1684 |
| E951 | K1076 | Y1244 | N1342 | R1509 | K1553 | K1685 |
| P956 | F1092 | G1245 | K1343 | N1510 | S1554 | E1689 |
| Y959 | K1097 | D1255 | N1350 | I1512 | D1557 | |
| Q964 | L1099 | K1261 | L1352 | A1513 | I1558 | |
| I969 | L1104 | S1263 | L1355 | H1514 | L1559 | |
| N994 | L1107 | L1267 | L1356 | N1516 | G1563 | |
| F1000 | K1113 | E1269 | I1359 | Y1517 | F1568 | |
| I10001 | Y1114 | K1274 | L1360 | L1529 | I1612 | |

-continued

| | | | | | |
|---|---|---|---|---|---|
| Q1003 | E1149 | I1277 | R1362 | L1530 | L1651 |
| F10005 | E1151 | E1278 | V1363 | E1534 | E1652 |
| K1007 | I1153 | L1289 | G1364 | L1536 | K1655 |
| G1008 | L1155 | H1290 | Y1365 | R1537 | H1658 |
| F1009 | L1158 | A1294 | I1369 | Y1543 | L1659 |
| N1019 | D1166 | N1320 | R1371 | D1544 | K1663 |
| L1020 | L1203 | K1325 | D1372 | R1545 | T1673 |
| K1021 | D1222 | E1327 | F1385 | K1546 | S1677 |
| I1023 | G1224 | Y1328 | E1391 | L1547 | E1678 |
| N1028 | I1228 | I1334 | D1459 | K1548 | E1679 |
| E1070 | R1236 | Y1337 | K1463 | N1549 | C1681 |

One or more of the indicated residue is mutated. Amino acid residue numbering corresponds to the numbering as indicated in FIG. 67A-67F (middle line between the two orthologous aligned sequences, indicating identical residues).

Any one or more of the residues indicated in FIG. 67A-67F, which are identical between Lew2 C2c2 and Lib C2c2 are mutated for modifying the C2c2 protein activity, specificity, or functionality. C2c2 proteins having any one or more of the above amino acid residues, alone, or in combination, mutated display altered specificity and/or activity and/or alternative PAM recognition.

Example 30: Methods

Cloning of Orthologs for Activity Screen and Recombinant Expression

We synthesized human codon-optimized versions of fifteen Cas13a orthologs (Genscript, Jiangsu, China) (Supplementary Table 9) and cloned them into a pACYC184 under expression by a pLac promoter. Adjacent to the Cas13a expression cassette, we cloned the ortholog's corresponding direct repeats flanking either a beta-lactamase targeting or non-targeting spacer. Spacer array expression was driven by the J23119 promoter.

For purification of LwaCas13a, we cloned the mammalian codon-optimized LwaCas13a sequence into a bacterial expression vector for protein purification (6×His (SEQ ID NO: 577)/Twin Strep SUMO, a pET-based expression vector received as a gift from Ilya Finkelstein, University of Texas-Austin).

All plasmids used in this study are listed in Supplementary Table 1.

Bacterial In Vivo Testing for Cas13a Activity and PFS Identity

The screen functions as follows. Briefly, Cas13a is programmed to target a 5' stretch of sequence on the β-lactamase transcript flanked by randomized PFS nucleotides. Cas13a cleavage activity results in death of bacteria under ampicillin selection and PFS depletion is subsequently analyzed by next generation sequencing. In order to allow for quantitative comparisons between orthologs, we cloned each Cas13a ortholog under a pLac promoter along with a single-spacer CRISPR array nearby under expression of the pJ23119 small RNA promoter.

To test for activity of Cas13a orthologs, 90 ng of ortholog expression plasmids, with either targeting or non-targeting guide, was co-transformed with 25 ng of a previously described beta-lactamase target plasmid[58] into NovaBlue Singles competent cells (Millipore). Post-transformation, cells were diluted, plated on LB-agar supplemented with 100 µg/µL ampicillin and 25 µg/µL chloramphenicol, and incubated at 37° C. overnight. Transformants were counted next day.

For determination of LshCas13a and LwaCas13a PFS identity, 40 ng of ortholog expression plasmids with either targeting or non-targeting spacer was co-transformed with 25 ng of beta-lactamase target plasmid into 2 aliquots of NovaBlue GigaSingles (Millipore) per biological replicate. Two biological replicates were performed. Post-transformation, cells were recovered at 37° C. in 500 µL of SOC (Thermo Fisher Scientific) per biological replicate for 1 hour, plated on bio-assay plates (Corning) with LB-agar (Affymetrix) supplemented with 100 µg/µL ampicillin and 25 µg/µL chloramphenicol, and incubated at 37° C. for 16 hours. Colonies were then harvested by scraping and plasmid DNA was purified with NucleoBond Xtra EF (Macherey-Nagel) for subsequent sequencing.

Harvested plasmid samples were prepared for next generation sequencing by PCR with barcoding primers and Illumina flow cell handles using NEBNext High Fidelity 2×Master Mix (New England Biosciences). PCR products were pooled and gel extracted using a Zymoclean gel extraction kit (Zymo Research) and sequenced using a MiSeq next generation sequencing machine (Illumina).

Computational Analysis of PFS

From next generation sequencing of the LshCas13a and LwaCas13a PFS screening libraries, we aligned the sequences flanking the randomized PFS region and extracted the PFS identities. We collapsed PFS identities to 4 nucleotides to improve sequence coverage, counted the frequency of each unique PFS, and normalized to total read count for each library with a pseudocount of 1. Enrichment of each distribution as displayed in FIG. 1E was calculated against the pACYC184 control (no protein/guide locus) as $-\log_2 (f_{condition}/f_{pACYC184})$, where $f_{condition}$ is the frequency of PFS identities in the experimental condition and $f_{pACYC184}$ is the frequency of PFS identities in the pACYC184 control. For analysis of a conserved PFS motif, top depleted PFS identities were calculated using each condition's non-targeting control as follows: $-\log 2(f_{i,targeting}/f_{i,non-targeting})$ where $f_{i,targeting}$ is the frequency of PFS identities in condition i with targeting spacer and $f_{i,non-targeting}$ is the frequency of PFS identities in condition i with non-targeting spacer. PFS motifs were analyzed for a range of thresholds as shown in Extended Data FIG. 1D, 1E.

Purification of LwaCas13a

Purification of LwaCas13a was performed as previously described[60]. Briefly, LwaCas13a bacterial expression vectors were transformed into Rosetta 2(DE3)pLysS singles Competent Cells (Millipore) and 4 L of Terrific Broth 4 growth media (TB) was seeded with a starter culture. Cell protein expression was induced with IPTG and after overnight growth, cell pellet was harvested and stored at −80° C. Following cell lysis, protein was bound using a StrepTactin Sepharose resin (GE) and protein was eluted by SUMO protease digestion (Thermo Fisher). Protein was further purified by cation exchange using a HiTrap SP HP cation exchange column (GE Healthcare Life Sciences) and subsequently by gel filtration using a Superdex 200 Increase 10/300 GL column (GE Healthcare Life Sciences), both steps via FPLC (AKTA PURE, GE Healthcare Life Sciences). Final fractions containing LwaCas13a protein were pooled and concentrated into Storage Buffer (600 mM NaCl, 50 mM Tris-HCl pH 7.5, 5% Glycerol, 2 mM DTT) and aliquots were frozen at −80° C. for long-term storage.

Cloning of Mammalian Expression Constructs

The human codon optimized Cas13a gene was synthesized (Genscript) and cloned into a mammalian expression vector with either a nuclear export signal (NES) or nuclear localization sequence (NLS) under expression by the EF1α promoter. Because of the stability conferred by monomeric-super-folded GFP (msfGFP), we fused msfGFP to the C-terminus of LwaCas13a. The full-length direct-repeat of LwaCas13a was used for cloning the guide backbone plasmid with expression under a U6 promoter. The catalytically-inactive LwaCas13a-msfGFP construct (dead Cas13a or dCas13a) was generated by introducing R474A and R1046A mutations in the two HEPN domains. A drug-selectable version of LwaCas13a-msfGFP was generated by cloning the protein into a backbone with Blasticidin selection marker linked to the C-terminus via a 2A peptide sequence. The negative feedback version of the dCas13a-msfGFP construct was generated by cloning zinc-finger binding site upstream of the promoter of dCas13a-msfGFP and fusing a Zinc finger and KRAB domain to the C-terminus.

The reporter luciferase construct was generated by cloning Cypridina luciferase (Cluc) under expression by CMV and *Gaussia* luciferase (Gluc) under expression by EF1α, both on a single vector. Expression of both luciferases on a single vector allows one luciferase to serve as a dosing control for normalization of knockdown of the other luciferase, controlling for variation due to transfection conditions.

For the endogenous knockdown experiments in FIG. 1G, guides and shRNAs were designed using the RNAxs siRNA design algorithm[37]. The prediction tool was used to design shRNAs and guides were designed in the same location to allow for comparison between shRNA and Cas13a knockdown.

The rice actin promoter (pOsActin) was PCR amplified from pANIC6A[88] and each Cas13a was PCR amplified from existing Cas13a constructs. These fragments were ligated into existing plant expression plasmids such that each Cas13a was driven by the rice actin promoter and transcription was terminated by the HSP terminator. Cas13a gRNAs were expressed from the rice U6 promoter (pOsU6). The gRNA target sequence was identical for each gene whereas the scaffold sequence was Cas13a-specific. In these experiments, we targeted the rice 5-enolpyruvylshikimate-3-phosphate synthase (OsEPSPS) gene, which is the target of glyphosate-based herbicides, and the rice hydroxycinnamoyl-CoA shikimate/quinate hydroxycinnamoyl transferase (OsHCT) gene, which is necessary for proper plant growth.

All guides and shRNAs used in this study are listed in Supplementary Tables 2 and 3.

Protoplast Preparation

Green rice protoplasts (*Oryza sativa* L. ssp. *japonica* var. Nipponbare) were prepared as previously described[80] with slight modifications. Seedlings were grown for 14 days and protoplasts resuspended in MMG buffer containing 0.1M $CaCl_2$. This modified MMG buffer was used to prepare fresh 40% PEG buffer as well as in place of WI buffer. Finally, protoplasts were kept in total darkness for 48 hours post-transformation. All other conditions were as previously described.

Nucleic Acid Target and crRNA Preparation for In Vitro Reactions and Collateral Activity For generation of nucleic acid targets, oligonucleotides were PCR amplified with KAPA Hifi HotStart t (Kapa Biosystems). dsDNA amplicons were gel extracted and purified using MinElute gel extraction kit (Qiagen). The resulting purified dsDNA was transcribed via overnight incubation at 30° C. with the HiScribe T7 Quick High Yield RNA Synthesis kit (New England Biolabs). Transcribed RNA was purified using the MEGAclear Transcription Clean-up kit (Thermo Fisher). All RNA targets used in this study are listed in Supplementary Table 4 and 6.

To generate crRNAs, oligonucleotides were ordered as DNA (Integrated DNA Technologies) with an additional 5' T7 promoter sequence. crRNA template DNA was annealed with a T7 primer (final concentrations 10 μM) and transcribed via overnight incubation at 37° C. with the HiScribe T7 Quick High Yield RNA Synthesis kit (New England Biolabs). The resulting transcribed crRNAs were purified with RNAClean XP beads (Beckman Coulter), using a 2×ratio of beads to reaction volume, supplemented with additional 1.8×ratio of isopropanol (Sigma). crRNA constructs used for in vitro experiments study are listed in Supplementary Table 5 and crRNA constructs used for collateral detection are listed in Supplementary Table 6.

LwaCas13a Cleavage and Collateral Activity Detection

For biochemical characterization of LwaCas13a, assays were performed as previously described[58]. Briefly, nuclease assays were performed with 160 nM of end-labeled ssRNA target, 200 nM purified LwaCas13a, and 100 nM crRNA, unless otherwise indicated. All assays were performed in nuclease assay buffer (40 mM Tris-HCl, 60 mM NaCl, 6 mM $MgCl_2$, pH 7.3). For array processing, 100ng of in vitro transcribed array was used per nuclease assay. Reactions were allowed to proceed for 1 hour at 37° C. (unless otherwise indicated) and were then quenched with proteinase buffer (proteinase K, 60 mM EDTA, and 4M Urea) for 15 minutes at 37° C. The reactions were then denatured with 4.5M urea denaturing buffer at 95° C. for 5 minutes. Samples were analyzed by denaturing gel electrophoresis on 10% PAGE TBE-Urea (Invitrogen) run at 45° C. Gels were imaged using an Odyssey scanner (LI-COR Biosciences).

Collateral activity detection assays were performed as previously described[90]. Briefly, reactions consisted of 45 nM purified LwCas13a, 22.5 nM crRNA, 125 nM quenched fluorescent RNA reporter (RNAse Alert v2, Thermo Scientific), 2 μL murine RNase inhibitor (New England Biolabs), 100 ng of background total human RNA (purified from HEK293FT culture), and varying amounts of input nucleic acid target, unless otherwise indicated, in nuclease assay buffer (40 mM Tris-HCl, 60 mM NaCl, 6 mM $MgCl_2$, pH 7.3). Reactions were allowed to proceed for 1-3 hr at 37° C. (unless otherwise indicated) on a fluorescent plate reader (BioTek) with fluorescent kinetics measured every 5 min.

RNA Extraction and qRT-PCR

Total RNA was isolated after 48 hours of incubation using Trizol and the accompanying protocol. One nanogram of total RNA was used in the SuperScript III Platinum SYBR Green One-Step qRT-PCR Kit (Invitrogen) using the accompanying protocol. All samples were run in technical triplicate of three biological replicates in a 384-well format on a LightCycler 480 Instrument (Roche). All PCR primers were verified as being specific based on melting curve analysis and are as follows: OsEPSPS (Os06 g04280), 5'-TTG CCA TGA CCC TTG CCG TTG TTG-3' (SEQ ID NO: 181) and 5'-TGA TGA TGC AGT AGT CAG GAC CTT-3' (SEQ ID NO: 182); OsHCT (Os11 g07960), 5'-CAA GTT TGT GTA CCC GAG GAT TTG-3' (SEQ ID NO: 183) and 5'-AGC TAG TCC CAA TAA ATA TGC GCT-3' (SEQ ID NO: 184); OsEF1α (Os03 g08020), 5'-CTG TAG TCG TTG GCT GTG GT-3' (SEQ ID NO: 185) and 5'-CAG CGT TCC CCA AGA AGA GT-3' (SEQ ID NO: 186). Primers for OsEF1α were previously described[91]. All data are presented as the mean plus/minus the standard error with each sample relative to the expression of EF1a.

Cloning of Tiling Guide Screens

For tiling guide screens, spacers were designed to target mRNA transcripts at even intervals to fully cover the entire length of the transcript. Spacers were ordered from IDT, annealed, and golden-gate cloned into LwaCas13a guide expression constructs with either a tRNA$^{val}$ promoter, for Gluc and Cluc screens, or U6 promoter, for all endogenous screens.

Mammalian Cell Culture and Transfection for Knockdown with LwaCas13a

All mammalian cell experiments were performed in the HEK293FT line (ATCC) unless otherwise noted. HEK293FT cells were cultured in Dulbecco's Modified Eagle Medium with high glucose, sodium pyruvate, and GlutaMAX (Thermo Fisher Scientific) supplemented with 10% fetal bovine serum (VWR Seradigm) and 1× Penicillin-Streptomycin (Thermo Fisher Scientific). Cells were passaged to maintain confluency below 70%. For experiments involving A375 (ATCC), cells were cultured in RPMI 1640 Medium (Thermo Fisher Scientific) supplemented with 9% fetal bovine serum (VWR Seradigm) and 1× Penicillin-Streptomycin (Thermo Fisher Scientific).

To test knockdown of endogenous genes, Lipofectamine 2000 (Thermo Fisher Scientific) transfections were performed with 150 ng of LwaCas13a plasmid and 250 ng of guide plasmid per well, unless otherwise noted. Experiments testing knockdown of reporter plasmids were supplemented with 12.5 ng reporter construct per well. 16 hours prior to transfection, cells were plated in 96-well plates at approximately 20,000 cells/well and allowed to grow to 90% confluency overnight. For each well, plasmids were combined with Opti-MEM® I Reduced Serum Medium (Thermo Fisher) to a total of 25 µL, and separately 0.5 µL of Lipofectamine 2000 was combined with 24.5 µL of Opti-MEM. Plasmid and lipofectamine solutions were then combined, incubated for 5 min, and slowly pipetted onto cells to prevent disruption.

Transformation of Green Rice Protoplasts

For the green rice experiments, plasmids expressing each Cas13a and the corresponding gRNA were mixed in equimolar ratios such that a total of 30 mg of DNA was used to transform a total of 200,000 protoplasts per transformation.

Measurement of Luciferase Activity

We harvested media containing secreted luciferase at 48 hours post transfection, unless otherwise noted. Media was diluted 1:5 in PBS and then luciferase activity was measured using the NEB Cypridina and *Gaussia* luciferase measurement kits on a Biotek Synergy 4 plate reader with an injection protocol. All replicates were performed as biological replicates.

Harvest of total RNA and Quantitative PCR 48 hours post-transfection, cells harvesting and reverse transcription for cDNA generation was performed using a previously described modification[92] of the commercial Cells-to-Ct kit (Thermo Fisher Scientific). Transcript expression was then quantified with qPCR using Fast Advanced Master Mix (Thermo Fisher Scientific) and TaqMan qPCR probes (Thermo Fisher Scientific, Supplementary Table 7 and 8) with GAPDH control probes (Thermo Fisher Scientific). All qPCR reactions were performed in 5 µL reactions with 4 technical replicates in 384-well format, and read out using a LightCycler 480 Instrument II (Roche). For multiplexed targeting reactions, readout of different targets was performed in separate wells.

Expression levels were calculated by subtracting housekeeping control (GAPDIH) Ct values from target Ct values to normalize for total input, resulting in ΔCt levels. Relative transcript abundance was computed as 2^(-ΔCt). All replicates were performed as biological replicates.

Computational Analysis of Target Accessibility

To first analyze target accessibility, we analyzed top guides from the tiling screen and determined whether they grouped closer together than expected with the assumption that if there were regions of accessibility, you would expect multiple guides in that region to be highly active. We defined top guides as the top 20% performing guides for the Gluc tiling screen and top 30% performing guides for the Cluc, KRAS, and PPIB tiling screens. We generated a null probability distribution for pair-wise distances between guides by randomly simulated 10,000 guide positions and then compared the experimentally determined top guide pair-wise distances.

Accessibility was predicted using the RNAplfold algorithm in the Vienna RNA software suite[93]. The default window size of 70 nt was used and probability of a target region being unpaired was calculated as the average of the 28 single-nucleotide unpaired probabilities across the target region. These accessibility curves were smoothened and compared to smoothened knockdown curves across each of the four transcripts and correlations between the two factors were computed using Pearson's correlation coefficient. The probability space of these two factors was also visualized by performing 2D kernel density estimation across the two variables.

RNA Sequencing and Analysis

To determine the specificity of LwaCas13a knockdown, we performed RNA sequencing on mRNA from knockdown experiments involving both LwaCas13a and shRNA constructs. Total RNA was prepared from transfection experiments after 48 hours using the Qiagen RNeasy Plus Mini kit. mRNA was then extracted using the NEBNext® Poly(A) mRNA Magnetic Isolation Module and RNA-seq libraries were prepared using the NEBNext® Ultra™ Directional RNA Library Prep Kit for Illumina®. RNA-sequencing libraries were sequenced on an Illumina NextSeq instrument with at least 10M reads per library.

An index was generated using the RefSeq GRCh38 assembly and reads were aligned and quantified using Bowtie and RSEM v1.2.31 using default parameters[94]. Transcript per million (TPM) values were used for expression counts and were transformed to log-space by taking the $\log_2(TPM+1)$.

To find differentially expressed genes, we performed Student's t-test on the three targeting replicates versus the three non-targeting replicates. The statistical analysis was only performed on genes that had a $\log_2(TPM+1)$ value greater than 2.5 in at least two of the 6 replicates. Only genes that had a differential expression greater than 2 or less than 0.75 and a false discovery rate <0.10 were reported to be significantly differentially expressed.

Cross-correlations between replicates and averages of replicates were performed using Kendall's tau coefficient. The variation of shRNA vs Cas13a libraries was analyzed by considering the distribution of standard deviations for gene expression across the 6 replicates (3 targeting and 3 non-targeting replicates) and plotted as violin plots.

Evaluation LwaCas13a for Collateral Activity in Mammalian Cells

LwaCas13a was additionally evaluated for collateral activity by testing for any potential growth restriction effects. Mammalian cells were transfected with luciferase reporter target, guide plasmid, and either LwaCas13a or drug-selectable LwaCas13a. 24 hours post-transfection, cells were split 1:5 into fresh media and drug-selectable LwaCas13a samples were supplemented with 10 µg/mL Blasticidin S (Thermo Fisher Scientific). After 48 hours of additional growth, cells were assayed for luciferase knockdown, maintenance of LwaCas13a expression via GFP fluorescence measurement on a multimode plate reader (Biotek Neo2), and cell growth by CellTiter-Glo® Luminescent Cell Viability Assay (Promega).

Quantifying dCas13a Binding with RIP

For RNA immunoprecipitation experiments, HEK293FT cells were plated in 6-well plates and transfected with 1.3 µg of dCas13a expression plasmid and 1.7 µg of guide plasmid, with an additional 150 ng of reporter plasmid for conditions involving reporter targeting. 48 hours post transfection, cells were washed twice with ice-cold PBS (Sigma) and fixed with 0.2% paraformaldehyde (Electron Microscopy Sciences) in PBS for 15 min at room temperature. After fixation, the paraformaldehyde was removed, 125 mM glycine in PBS was added to quench crosslinking, and the cells were incubated for 10 minutes. Cells were washed twice again with ice-cold PBS, harvested by scraping, and the cell suspension was centrifuged at 800 g for 4 min to pellet the cells. The supernatant was removed and the pellet was washed with PBS prior to lysis. Cells were lysed with 200 µg of 1×RIPA Buffer (Cell Signaling) supplemented with cOmplete™ ULTRA Tablets, EDTA-free (Sigma) and Ribonuclease inhibitor (Sigma R1158). Cells were allowed to lyse on ice for 10 min and then sonicated for 2 min with a 30 sec on/30 sec off cycle at low intensity on a Bioruptor sonicator (Diagenode). Insoluble material pelleted by centrifugation at 16,000 g for 10 min at 4° C., and the supernatant containing cleared lysate was used for pulldown with magnetic beads.

To conjugate antibodies to magnetic beads, 100 µL/sample of Dynabeads® Protein A for Immunoprecipitation (Thermo Fisher Scientific) were pelleted by application of a magnet, and the supernatant was removed. Beads were resuspended in 200 µL of wash buffer (PBS supplemented with 0.02% Tween-20 (Sigma)) and 5 µg of rabbit Anti-Mouse IgG (Sigma M703) was added. The sample was incubated for 10 min at room temperature on a rotator to allow antibody to conjugate to the beads. After incubation, beads were pelleted via magnet, supernatant was removed, and beads were washed twice with wash buffer. The pellet was resuspended in 100 µL wash buffer and split into two 50 µL volumes for conjugation of Anti-HA antibody (Thermo Fisher Scientific 26183) or IgG antibody control (Sigma I5381). For each antibody, 2.5 µg of antibody was added with 200 µL wash buffer and incubated for 10 min at room temperature on a rotator. Post-incubation, beads were pelleted via magnet and washed twice with wash buffer, and resuspended in 200 µL 1×RIPA with Ribonuclease inhibitor (Sigma R1158) and protease inhibitor cocktail (Sigma P8340). 100 µL of sample lysate was added to beads and rotated overnight at 4° C.

After incubation with sample lysate, beads were pelleted, washed three times with 1×RIPA, 0.02% Tween-20, and then washed with DNase buffer (350 mM Tris-HCl [pH 6.5]; 50 mM MgCl2; 5 mM DTT). Beads were resuspended in DNase buffer and TURBO DNase (Life Technologies) was added to final concentration of 0.08 units/µl. DNase was incubated 30 min at 370 C on a rotator. Proteins were then digested by addition of Proteinase K (New England Biosciences) to a final concentration of 0.1 units/µl and incubated at 37° C. with rotation for an additional 30 min. For denaturation and purification, urea (Sigma) was added to a final concentration of 2.5 M, samples were incubated for 30 min, and RNA was purified using a Direct-Zol RNA miniprep (Zymo Research). Purified RNA was reverse transcribed to cDNA using the qScript Flex cDNA (Quantabio) and pulldown was quantified with qPCR using Fast Advanced Master Mix and TaqMan qPCR probes (Supplementary Table 7 and 8). All qPCR reactions were performed in 5 µL reactions with 4 technical replicates in 384-well format, and read out using a LightCycler 480 Instrument II. Enrichment was quantified for samples as compared to their matched IgG antibody controls.

Translocation Measurement of LwaCas13a and LwaCas13a-NF

HEK293FT cells were plated in 24-well tissue culture plates on poly-D-lysine coverslips (Corning) and transfected with 150ng dCas13a-NF vector and 300ng guides for imaging ACTB. For translocation experiments, cells were fixed with 4% PFA and permeabilized with 0.2% Triton X-100 after 48 hours and mounted using antifade mounting medium with DAPI (Vectashield). Confocal microscopy was performed using a Nikon Eclipse Ti1 with Andor Yokogawa Spinning disk Revolution WD system.

Nuclear export of dCas13a-NF-msfGFP with guides targeting ACTB mRNA was analyzed by measuring the average cytoplasmic and nuclear msfGFP fluorescence and comparing the ratio across many cells between targeting and non-targeting conditions.

Fluorescent In Situ Hybridization (FISH) of ACTB Transcript

HEK293FT cells were plated in 24-well tissue culture plates on poly-D-lysine coverslips (Corning) and transfected with 75ng dCas13a-NF vector and 250ng guides for imaging ACTB. After 48 hours, cells were fixed with 4% PFA for 45 minutes. The QuantiGene viewRNA ISH Cell assay kit (Affymetrix) was used for performing the FISH on the cell samples and the protocol was followed as described by the manufacturer. After finishing the FISH procedure, coverslips were mounted using antifade mounting medium (Vectashield). Confocal microscopy was performed using a Nikon Eclipse Ti1 with Andor Yokogawa Spinning disk Revolution WD system.

Tracking of LwaCas13a to Stress Granules

HEK293FT cells were plated in 24-well tissue culture plates on poly-D-lysine coverslips (Corning) and transfected with 75ng dCas13a-NF vector and 250ng guides for imaging ACTB. For stress granule experiments, 200 µM sodium arsenite was applied for 1 hour prior to fixing and permeabilizing the cells. For immunofluorescence of G3BP1, cells were blocked with 20% goat serum, and incubated overnight at room temperature with anti-G3BP1 primary antibody (Abnova H00010146-B01P). Cells were then incubated with secondary antibody labeled with Alexa Fluor 594 and mounted using anti-fade mounting medium with DAPI (Vectashield). Confocal microscopy was performed using a Nikon Eclipse Ti1 with Andor Yokogawa Spinning disk Revolution WD system.

Stress granule co-localization with dCas13a-NF-msfGFP was calculated using the average msfGFP and G3BP1 signal per cell using Pearson's correlation coefficient. The colocalization analyses were performed in the image analysis software FIJI[95] using the Coloc 2 plugin.

For live imaging experiments, HEK293FT cells were plated in 96-well tissue culture plates and transfected with 150ng dCas13a-NF vector, 300ng guides for imaging ACTB, and 5ng of G3BP1-RFP reporter. After 48 hours, the cells were subjected to 0 µM or 400 µM sodium arsenite and imaged every 15 minutes every 2 hours on an Opera Phenix™ High Content Screening System (PerkinElmer) using the spinning disk confocal setting with 20×water objective. Cells were maintained at 37° C. in a humidified chamber with 50% $CO_2$. Live cell dCas13a-NF-msfGFP colocalization with G3BP1-RFP in stress granules was measured using the Opera Phenix Harmony software (PerkinElmer).

Correlation of Target Accessibility and Knockdown

We showed that LshCas13a targeted the MS2 ssRNA genome in defined locations with highly effective guides grouping together closer than would be expected by chance[1]. We hypothesized that clusters of effective guides could arise from regions of accessibility being better targeted by LshCas13a due to sterics and availability of target binding. We sought to analyze whether these results would extend to targeting of mammalian mRNAs with LwCas13a and so performed a similar analysis on the four genes we tiled with guides: Gluc, Cluc, KRAS, and PPIB. We first defined effective guides as the top 20% of guides for Gluc and top 30% of guides for the other three genes as measured by knockdown efficiency (note that we are more generous with the threshold on Cluc, KRAS, and PPIB because they were tiled with 50% fewer guides than Gluc). In analyzing only the most effective guides as defined using these thresholds, we found that they do cluster closer together than expected by chance.

We next sought to model the accessibility of the target transcript using the RNAplfold algorithm from the Vienna RNA software suite. We calculated the accessibility across windows of size 70 (default), and the probability that a given nucleotide position on the transcript would be unpaired. For a given guide, we can then average the probabilities across the 28 nt to obtain the average probability that a given guide target is unpaired and thus accessible. We take this calculation as a measure for target accessibility and compare against the target expression for each guide. Because of the variation that occur from guide to guide, especially because the genes are not densely tiled, we decided to smooth both the target accessibility and target expression curves. By plotting these curves and analyzing the correlation, we found that target accessibility is significantly correlated to target expression and that it can explain 4.4%-16% of the variation in target expression. To offset spurious effects of the smoothing, we also analyzed the probability versus knockdown data in probability space by using kernel density estimation. This analysis revealed a similar positive relationship between the probability of a target region being base-paired and target expression. Finally, to offset any parameter-specific aspects of RNAplfold yielding spurious correlations for the base-pairing probability, we calculated the unpaired probability for a grid of parameters: window size and k-mer size. We initially only calculated the probability for k-mers of 1, i.e. probability that a given position is unpaired averaged across the 28 nt target region. With k=2, we calculate the probability pairs of nucleotides are unpaired and average those across the 28 nt region and so on for k up to 28. This analysis revealed regions of parameters for each transcript yielding positive correlations which provides more confidence that it's not just a specific parameter set giving a correlation. As might be expected, a larger transcript such as KRAS has positive correlations for larger window sizes versus smaller transcripts such as PPIB, which had positive correlations for much smaller window sizes.

Comparison of Target Knockdown Specificity Between shRNA and Cas13a

For rigorous comparison between shRNA and Cas13a transcript knockdown specificity, we wanted to evaluate the transcriptome-wide effects of perturbation compared between targeting and non-targeting controls. Off-targets will appear as deviations from the identity line, and it is apparent that more off-targets occur for shRNA than for Cas13a when targeting reporter constructs. Similar increased deviation occurs for endogenous genes. While it may be expected that knockdown of endogenous transcripts would result in additional gene expression changes from changes in biological function, we find that PPIB and KRAS knockdown with Cas13a does not result in expression changes, possibly because the level of knockdown is not adequate for substantial downstream effects.

Next, we quantified the number of off-targets via differential gene expression: off-target transcripts were defined as genes with at least 100% up-regulation or 25% down-regulation. Significant off-targets were then compared between targeting and non-targeting conditions by Student's t-test with multiple comparisons corrected via Benjamini-Hochberg procedure with an FDR of 0.1. We found that for all three transcripts tested, there were hundreds of significant off-target transcripts as a result of shRNA targeting, but no significant off-targets as a result of Cas13a targeting.

The large variation in shRNA perturbations between targeting and non-targeting conditions could either be due to increased overall gene expression variation, which would result in similar deviations between biological replicates, or reproducible and consistent off targets, which would manifest as increased correlations between replicates for the same condition. Comparing the non-targeting and targeting replicates to each other for Gluc perturbation, we found little variation between replicates. However, when we compared individual replicates of targeting conditions versus all non-targeting conditions for either shRNA or Cas13a, we found that comparisons between replicates recapitulated the off-targets seen for mean measurements. To quantify the correlations between replicates, we compared all replicates for targeting and non-targeting conditions across reporter and endogenous genes. shRNA samples correlated higher within replicates than between non-targeting and targeting conditions, while correlations between Cas13a samples had less variation between targeting and non-targeting perturbations. We then compared all samples between each other and found that shRNA samples had lower correlation between samples and with Cas13a than within Cas13a, showing that Cas13a was more consistent. Lastly, we calculated the standard deviation per gene across both targeting and non-targeting replicates, and found that the distribution of standard deviations was lower for Cas13a perturbations than for shRNA perturbations across the transcriptome. Overall, this evidence shows that Cas13a targeting results in less transcriptome-wide variation.

Evidence for Lack of Collateral Activity in Mammalian Cells

LshCas13a and LwCas13a seems to display robust collateral activity in vitro. Because of concerns about cell health and the specificity of LwCas13a knockdown due to the collateral effect, we have attempted to study whether the collateral effect is in fact present in mammalian cells. Throughout our manuscript, we collect data that suggests a lack of collateral activity for LwCas13a, and here, we gather all the pieces of evidence and discuss them in detail.

1. RNA sequencing: We performed RNA sequencing to determine the specificity of LwCas13a knockdown and found that LwCas13a displayed much greater specificity than RNAi. In our differential expression analysis, there were no significantly differentially expressed off-targets for any LwCas13a condition analyzed, despite significant knockdown of the target transcript. Assuming that there was not uniform knockdown of every transcript in the human transcriptome, we believe that this offers substantial evidence that knockdown by LwCas13a is specific and there is no collateral effect in mammalian cells.

2. Tiling screens: In the four gene tiling screens we performed, we failed to see knockdown of the control genes used for normalization. This is a similar analysis to the RNA sequencing, although focused on just one other gene rather than the transcriptome. This result is important, however, because we fail to see collateral activity across hundreds of guides tested, providing confidence that LwCas13a robustly shows no collateral activity in vivo.

3. Leave one out multiplexing: To ascertain the specificity of gene knockdown in our multiplexing experiments, we designed an experiment where each gene-targeting guide is replaced by a non-targeting guide in a guide expression array containing guides against three different genes. We found that there was no significant change in gene expression for the gene targeted by the missing guide. We believe this is also a nice demonstration that there is a lack of collateral activity in mammalian cells because we would expect all three genes to always show knockdown despite whether its guide is present or missing.

4. Growth experiment: Previously, we showed that LshCas13a caused growth restriction in bacteria during gene knockdown[1]. We designed a straightforward experiment to measure whether there was growth effects of knockdown in mammalian cells. We allowed cells with LwCas13a targeting Gluc to grow for 72 hours and then measured cell viability and found that there was no difference in growth between targeting and non-targeting guide conditions. We additionally controlled for LwCas13a expression by looking at fluorescence of a C-terminal msfGFP fusion and showed that expression was the same across all conditions and not selected out due to a potentially deleterious phenotype. There are many possible reasons for a lack of growth inhibition in mammalian cells despite previous observations of bacterial growth suppression, including differences in the RNA cytoplasmic density, cytosol composition, and mechanisms for processing of cleaved transcripts.

Points 1-3 collectively show that targeted gene knockdown does not affect other genes beyond the targeted gene and Point 4 reveals that there is no observable side effects for gene knockdown. We believe that this data all together is substantial evidence for a lack of LwCas13a collateral activity in mammalian cells and that Cas13 knockdown is quite specific.

Importance of Negative-Feedback Construct for dCas13a Imaging

For live-cell imaging, it is important to maintain a high signal to noise ratio and reduce background. The concern of background is especially important for fluorophore-labeled constructs, such as dCas13a, as unbound dCas13a cannot be removed from the cell or distinguished from bound protein. One approach to reducing background is sequestration of the protein in the nucleus via nuclear localization signal (NLS) tags; upon nascent transcript binding, the protein is transiently exported to the cytoplasm. Although this technique has been utilized in MS2 systems, we found that it was imperfect due to the off-target nuclear leakage and on-target nuclear escape. To improve upon the signal to noise of NLS-tagging alone, we incorporated a negative feedback system where nuclear resident protein will inhibit further expression of dCas13a. We find that negative feedback regulation reduces spurious translocation to the cytoplasm and leads to reduced overall levels of dCas13a-NF levels in non-targeting conditions compared to targeting conditions, thereby increasing the utility of dCas13a as an imaging tool.

Supplementary Tables

SUPPLEMENTARY TABLE 1

Plasmids used in this study.

| Plasmid Name | Description |
|---|---|
| pC004 | beta-lactamase screening target |
| pC014 | LwaCas13a-msfGFP |
| pC015 | dLwaCas13a-NF |
| pC016 | LwaCas13a guide expression backbone with U6 promoter |
| pC017 | LwaCas13a guide expression backbone with tRNAval promoter |
| pC018 | LshCas13a from *Leptotrichia shahii* |
| pC019 | LwaCas13a from *Leptotrichia wadei* |
| pC020 | LseCas13a from *Listeria seeligeri* |
| pC021 | LbmCas13a from Lachnospiraceae bacterium MA2020 |
| pC022 | LbnCas13a from Lachnospiraceae bacterium NK4A179 |
| pC023 | CamCas13a from [*Clostridium*] *aminophilum* DSM 10710 |
| pC024 | CgaCas13a from *Carnobacterium gallinarum* DSM 4847 |
| pC025 | Cga2Cas13a from *Carnobacterium gallinarum* DSM 4847 |
| pC026 | PprCas13a from *Paludibacter propionicigenes* WB4 |
| pC027 | LweCas13a from *Listeria weihenstephaensis* ESL R9-0317 |
| pC028 | LbfCas13a from Listeriaceae bacterium FSL M6-0635 |
| pC029 | Lwa2Cas13a from *Leptotrichia wadei* F0279 |
| pC030 | RcsCas13a from *Rhodobacter capsulatus* SB 1003 |
| pC031 | RcrCas13a from *Rhodobacter capsulatus* R121 |
| pC032 | RcdCas13a from *Rhodobacter capsulatus* DE442 |
| pC033 | Dual luciferase reporter (Gluc and CluC) |
| pC034 | LwaCas13a-msfGFP-2A-Blast |
| pC035 | dLwaCas13a-msfGFP |

SUPPLEMENTARY TABLE 2

Guides used for in vivo experiments in this study.

| Name | SEQ ID NO: | Guide sequence | PFS |
|---|---|---|---|
| PFS targeting spacer | 187 | AGATTGCTGTtctaccaagtaatccata | N/A |
| PFS non-targeting spacer | 188 | tatggattacttggtagaACAGCAATCT | N/A |
| Glue guide 1 | 189 | ATCAGGGCAAACAGAACTTTGACTCCca | C |
| Glue guide 2 | 190 | GTGCAGCCAGCTTTCCGGGCATTGGCTT | C |
| Non-targeting guide | 191 | tagattgctgttctaccaagtaatccat | N/A |
| PPIB RNAxs guide 1 | 192 | tccttgattacacgatggaatttgctgt | C |

SUPPLEMENTARY TABLE 2-continued

Guides used for in vivo experiments in this study.

| Name | SEQ ID NO | Guide sequence | PFS |
|---|---|---|---|
| CXCR4 RNAxs guide 1 | 193 | atgataatgcaatagcaggacaggatga | C |
| KRAS RNAxs guide 1 | 194 | aatttctcgaactaatgtatagaaggca | C |
| EPSPS guide 1 | 195 | CCACCACCACCGCCTCCCGCCGCCCCCG | C |
| EPSPS guide 2 | 196 | TGCTCCCATCATCTCAAGTACCTCAGCA | A |
| EPSPS guide 3 | 197 | CCCTTGACACGAACAGGTGGGCATTCAG | A |
| HCT guide 1 | 198 | AGAAGGTCACCTGTACGGCGAGCACGGC | T |
| HCT guide 2 | 199 | CAGATCCGCTTGAGGGTGGCGATCTGGT | C |
| HCT guide 3 | 200 | CCGGACGATCGGGCATCCCCGCCATCTC | A |
| PDS guide 1 | 201 | GACTGAGCACAAAGCTTCCCAGATAGAA | T |
| PDS guide 2 | 202 | ACCATCCAAGAATGCCATCTTAGAACCA | A |
| PDS guide 3 | 203 | CCTGGCAAACAACCTGTAGAGCACCGAG | A |
| Non-targeting guide for green rice protoplast experiment | 204 | TAGATTGCTGTTTCACACAGATATGCAT | N/A |
| KRAS top guide 1 | 205 | tataatggtgaatatcttcaaatgattt | G |
| KRAS top guide 2 | 206 | atgtatagaaggcatcatcaacaccctg | U |
| KRAS top guide 3 | 207 | ggttaaaaatttacagattgtgctgagc | U |
| PPIB top guide 1 | 208 | gtagatgctctttcctcctgtgccatct | G |
| PPIB top guide 2 | 209 | cagtttgaagttctcatcggggaagcgc | A |
| PPIB top guide 3 | 210 | cagtgttggtaggagtttgttacaaaag | A |
| MALAT1 top guide 1 | 211 | CTTGGCCAAGTCTGTTATGTTCACCTGA | C |
| MALAT1 top guide 2 | 212 | CAAAATGTACTCAGCTTCAATCACAAAT | C |
| MALAT1 top guide 3 | 213 | GGTTATAGCTTGACAAGCAATTAACTTT | A |
| PPIB multiplexing guide | 214 | tccttgattacacgatggaatttgctgt | C |
| CXCR4 multiplexing guide | 215 | atgataatgcaatagcaggacaggatga | C |
| KRAS multiplexing guide | 216 | aatttctcgaactaatgtatagaaggca | C |
| TINCR multiplexing guide | 217 | gcgtgagccaccgcgcctggccggctgt | C |
| PCAT multiplexing guide | 218 | ccagctgcagatgctgcagttttttggcg | C |
| gLuc1_WT | 219 | ATCAGGGCAAACAGAACTTTGACTCCCA | C |
| gLuc1_1 | 220 | TTCAGGGCAAACAGAACTTTGACTCCCA | C |
| gLuc1_4 | 221 | ATCTGGGCAAACAGAACTTTGACTCCCA | C |

SUPPLEMENTARY TABLE 2-continued

Guides used for in vivo experiments in this study.

| Name | SEQ ID NO | Guide sequence | PFS |
|---|---|---|---|
| gLuc1_7 | 222 | ATCAGGCCAAACAGAACTTTGACTCCCA | C |
| gLuc1_10 | 223 | ATCAGGGCATACAGAACTTTGACTCCCA | C |
| gLuc1_13 | 224 | ATCAGGGCAAACTGAACTTTGACTCCCA | C |
| gLuc1_16 | 225 | ATCAGGGCAAACAGATCTTTGACTCCCA | C |
| gLuc1_19 | 226 | ATCAGGGCAAACAGAACTATGACTCCCA | C |
| gLuc1_22 | 227 | ATCAGGGCAAACAGAACTTTGTCTCCCA | C |
| gLuc1_25 | 228 | ATCAGGGCAAACAGAACTTTGACTGCCA | C |
| gLuc1_28 | 229 | ATCAGGGCAAACAGAACTTTGACTCCCT | C |
| CXCR4_WT | 230 | ATGATAATGCAATAGCAGGACAGGATGA | C |
| CXCR4_1 | 231 | TTGATAATGCAATAGCAGGACAGGATGA | C |
| CXCR4_4 | 232 | ATGTTAATGCAATAGCAGGACAGGATGA | C |
| CXCR4_7 | 233 | ATGATATTGCAATAGCAGGACAGGATGA | C |
| CXCR4_10 | 234 | ATGATAATGGAATAGCAGGACAGGATGA | C |
| CXCR4_13 | 235 | ATGATAATGCAAAGCAGGACAGGATGA | C |
| CXCR4_16 | 236 | ATGATAATGCAATAGGAGGACAGGATGA | C |
| CXCR4_19 | 237 | ATGATAATGCAATAGGAGCACAGGATGA | C |
| CXCR4_22 | 238 | ATGATAATGCAATAGCAGGACTGGATGA | C |
| CXCR4_25 | 239 | ATGATAATGCAATAGCAGGACAGGTTGA | C |
| CXCR4_28 | 240 | ATGATAATGCAATAGCAGGACAGGATGT | C |
| gLuc3_WT | 241 | GTGCAGCCAGCTTTCCGGGCATTGGCTT | C |
| gLuc3_1 | 242 | CTGCAGCCAGCTTTCCGGGCATTGGCTT | C |
| gLuc3_4 | 243 | GTGGAGCCAGCTTTCCGGGCATTGGCTT | C |
| gLuc3_7 | 244 | GTGCAGGCAGCTTTCCGGGCATTGGCTT | C |
| gLuc3_10 | 245 | GTGCAGCCACCTTTCCGGGCATTGGCTT | C |
| gLuc3_13 | 246 | GTGCAGCCAGCTATCCGGGCATTGGCTT | C |

SUPPLEMENTARY TABLE 2-continued

Guides used for in vivo experiments in this study.

| Name | SEQ ID NO | Guide sequence | PFS |
|---|---|---|---|
| gLuc3_16 | 247 | GTGCAGCCAGCTTTCGGGGCATTGGCTT | C |
| gLuc3_19 | 248 | GTGCAGCCAGCTTTCCGGCCATTGGCTT | C |
| gLuc3_22 | 249 | GTGCAGCCAGCTTTCCGGGCAATGGCTT | C |
| gLuc3_25 | 250 | GTGCAGCCAGCTTTCCGGGCATTGCCTT | C |
| gLuc3_28 | 251 | GTGCAGCCAGCTTTCCGGGCATTGGCTA | C |
| KRAS_top_tiling_WT | 252 | TATAATGGTGAATATCTTCAAATGATTT | G |
| KRAS_top_tiling_1 | 253 | AATAATGGTGAATATCTTCAAATGATTT | G |
| KRAS_top_tiling_4 | 254 | TATTATGGTGAATATCTTCAAATGATTT | G |
| KRAS_top_tiling_7 | 255 | TATAATCGTGAATATCTTCAAATGATTT | G |
| KRAS_top_tiling_10 | 256 | TATAATGGTCAATATCTTCAAATGATTT | G |
| KRAS_top_tiling_13 | 257 | TATAATGGTGAAAATCTTCAAATGATTT | G |
| KRAS_top_tiling_16 | 258 | TATAATGGTGAATATGTTCAAATGATTT | G |
| KRAS_top_tiling_19 | 259 | TATAATGGTGAATATCTTGAAATGATTT | G |
| KRAS_top_tiling_22 | 260 | TATAATGGTGAATATCTTCAATTGATTT | G |
| KRAS_top_tiling_25 | 261 | TATAATGGTGAATATGTTCAAATGTTTT | G |
| KRAS_top_tiling_28 | 262 | TATAATGGTGAATATCTTCAAATGATTA | G |
| PPIB_top_tiling_WT | 263 | GTAGATGCTCTTTCCTCCTGTGCCATCT | G |
| PPIB_top_tiling_1 | 264 | CTAGATGCTCTTTCCTCCTGTGCCATCT | G |
| PPIB_top_tiling_4 | 265 | GTACATGCTCTTTCCTCCTGTGCCATCT | G |
| PPIB_top_tiling_7 | 266 | GTAGATCCTCTTTCCTCCTGTGCCATCT | G |
| PPIB_top_tiling_10 | 267 | GTAGATGCTGTTTCCTCCTGTGCCATCT | G |
| PPIB_top_tiling_13 | 268 | GTAGATGCTCTTACCTCCTGTGCCATCT | G |
| PPIB_top_tiling_16 | 269 | GTAGATGCTCTTTCCACCTGTGCCATCT | G |
| PPIB_top_tiling_19 | 270 | GTAGATGCTCTTTCCTCCAGTGCCATCT | G |
| PPIB_top_tiling_22 | 271 | GTAGATGCTCTTTCCTCCTGTCCCATCT | G |

SUPPLEMENTARY TABLE 2-continued

Guides used for in vivo experiments in this study.

| Name | SEQ ID NO: | Guide sequence | PFS |
|---|---|---|---|
| PPIB_top_tiling_25 | 272 | GTAGATGCTCTTTCCTCC TGTGCCTTCT | G |
| PPIB_top_tiling_28 | 273 | GTAGATGCTCTTTCCTCC TGTGCCATCA | G |
| gLuc3_WT | 274 | GTGCAGCCAGCTTTCCGG GCATTGGCTT | C |
| gLuc3_double_consec_1 | 275 | CAGCAGCCAGCTTTCCGG GCATTGGCTT | C |
| gLuc3_double_consec_4 | 276 | GTGGTGCCAGCTTTCCGG GCATTGGCTT | C |
| gLuc3_double_consec_7 | 277 | GTGCAGGGAGCTTTCCGG GCATTGGCTT | C |
| gLuc3_double_consec_10 | 278 | GTGCAGCCACGTTTCCGG GCATTGGCTT | C |
| gLuc3_double_consec_13 | 279 | GTGCAGCCAGCTAACCG GGCATTGGCTT | C |
| gLuc3_double_consec_16 | 280 | GTGCAGCCAGCTTTCGCG GCATTGGCTT | C |
| gLuc3_double_consec_19 | 281 | GTGCAGCCAGCTTTCCGG CGATTGGCTT | C |
| gLuc3_double_consec_22 | 282 | GTGCAGCCAGCTTTCCGG GCAAAGGCTT | C |
| gLuc3_double_consec_25 | 283 | GTGCAGCCAGCTTTCCGG GCATGCGTT | C |
| gLuc3_double_nonconsec_1 | 284 | CTGCTGCCAGCTTTCCGG GCATTGGCTT | C |
| gLuc3_double_nonconsec_2 | 285 | CTGCAGCCTGCTTTCCGG GCATTGGCTT | C |
| gLuc3_double_nonconsec_3 | 286 | CTGCAGCCAGCTATCCGG GCATTGGCTT | C |
| gLuc3_double_nonconsec_4 | 287 | CTGCAGCCAGCTTTCCCG GCATTGGCTT | C |
| gLuc3_double_nonconsec_5 | 288 | GTGGAGCGAGCTTTCCGG GCATTGGCTT | C |
| gLuc3_double_nonconsec_6 | 289 | GTGGAGCCAGCATTCCG GGCATTGGCTT | C |
| gLuc3_double_nonconsec_7 | 290 | GTGGAGCCAGCTTTCGGG GCATTGGCTT | C |
| gLuc3_double_nonconsec_8 | 291 | GTGGAGCCAGCTTTCCGG GGATTGGCTT | C |
| gLuc3_double_nonconsec_9 | 292 | GTGCAGGCAGGTTTCCGG GCATTGGCTT | C |
| gLuc3_double_nonconsec_10 | 293 | GTGCAGGCAGCTTTGCGG GCATTGGCTT | C |
| gLuc3_double_nonconsec_11 | 294 | GTGCAGGCAGCTTTCCGG CCATTGGCTT | C |
| gLuc3_double_nonconsec_12 | 295 | GTGCAGGCAGCTTTCCGG GCATAGGCTT | C |
| gLuc3_double_nonconsec_13 | 296 | GTGCAGCCACCTTACCGG GCATTGGCTT | C |

SUPPLEMENTARY TABLE 2-continued

Guides used for in vivo experiments in this study.

| Name | SEQ ID NO:Guide sequence | | PFS |
|---|---|---|---|
| gLuc3_double_nonconsec_14297 | | GTGCAGCCACCTTTCCGC GCATTGGCTT | C |
| gLuc3_double_nonconsec_15298 | | GTGCAGCCACCTTTCCGG GCAATGGCTT | C |
| gLuc3_double_nonconsec_16299 | | GTGCAGCCACCTTTCCGG GCATTGGGTT | C |
| gLuc3_double_nonconsec_17300 | | GTGCAGCCAGCTATCCCG GCATTGGCTT | C |
| gLuc3_double_nonconsec_18301 | | GTGCAGCCAGCTATCCGG GCTTTGGCTT | C |
| gLuc3_double_nonconsec_19302 | | GTGCAGCCAGCTATCCGG GCATTGCCTT | C |
| gLuc3_double_nonconsec_20303 | | GTGCAGCCAGCTTTCGGG GGATTGGCTT | C |
| gLuc3_double_nonconsec_21304 | | GTGCAGCCAGCTTTCGGG GCATTCGCTT | C |
| gLuc3_double_nonconsec_22305 | | GTGCAGCCAGCTTTCGGG GCATTGGCTA | C |
| gLuc3_double_nonconsec_23306 | | GTGCAGCCAGCTTTCCGG CCATAGGCTT | C |
| gLuc3_double_nonconsec_24307 | | GTGCAGCCAGCTTTCCGG CCATTGGCAT | C |
| Glue RNA seq guide | 308 | ATCAGGGCAAACAGAAC TTTGACTCCca | C |
| KRAS RNA seq guide | 309 | gctgtaataattaggtaacatttatttc | C |
| PPIB RNA seq guide | 310 | gtcagtgttggtaggagtttgttacaaa | C |
| Glue RNA seq guide 2 | 311 | GTGCAGCCAGCTTTCCGG GCATTGGCTT | C |
| ACTB guide 1 | 312 | ctggcggcgggtgtggacgggcggcg ga | C |
| ACTB guide 2 | 313 | gagccacacgcagctcattgtagaaggt | C |

SUPPLEMENTARY TABLE 3 shRNA used in this study.

| Name | SEQ ID NO: | Guide sequence |
|---|---|---|
| Glue shRNA 1 | 314 | AAAGUUCUGUUUGCCCUGAUCcucgag-GAUCAGGGCAAACAGAACUUU |
| Glue shRNA 2 | 315 | AAGCCAAUGCCCGGAAAGCUG-cucgagCAGCUUUCCGGGCAUUGGCUU |
| Non-targeting shRNA | 316 | UAGAUUGCUGUUCUACCAAGUcucga-gACUUGGUAGAACAGCAAUCUA |
| PPIB RNAxs shRNA 1 | 317 | ACAGCAAAUUCCAUCGUGUAA-cucgagUUACACGAUGGAAUUUGCUGU |
| CXCR4 RNAxs shRNA 1 | 318 | AUCCUGUCCUGCUAUUGCAUU-cucgagAAUGCAAUAGCAGGACAGGAU |
| KRAS RNAxs shRNA 1 | 319 | CCUUCUAUACAUUAGUUCGAGcucgag-CUCGAACUAAUGUAUAGAAGG |
| Glue top shRNA 1 | 320 | AAGCCAAUGCCCGGAAAGCUG-cucgagCAGCUUUCCGGGCAUUGGCUU |
| Glue top shRNA 2 | 321 | AGAUUCCUGGGUUCAAGGACU-cucgagAGUCCUUGAACCCAGGAAUCU |

SUPPLEMENTARY TABLE 3-continued shRNA used in this study.

| Name | SEQ ID NO: | Guide sequence |
|---|---|---|
| Gluc top shRNA 3 | 322 | AAAGUUCUGUUUGCCCUGAUCcucgag-GAUCAGGGCAAACAGAACUUU |
| Clue top shRNA 1 | 323 | AAGUGGCUGGAGACAUCAUUG-cucgagCAAUGAUGUCUCCAGCCACUU |
| Clue top shRNA 2 | 324 | AAGCCGUGUCCGUCCCGUACA-cucgagUGUACGGGACGGACACGGCUU |
| KRAS top shRNA 1 | 325 | AAGACCUUAAUUCUUGCCGUU-cucgagAACGGCAAGAAUUAAGGUCUU |
| KRAS top shRNA 2 | 326 | AAUCAUUUGAAGAUAUUCACC-cucgagGGUGAAUAUCUUCAAAUGAUU |
| KRAS top shRNA 3 | 327 | AGGGUGUUGAUGAUGCCUUCU-cucgagAGAAGGCAUCAUCAACACCCU |
| PPIB top shRNA 1 | 328 | AAUCUGUAAAUUUUUAACCUAcucg-agUAGGUUAAAAAUUUACAGAUU |
| PPIB top shRNA 2 | 329 | AGAUGGCACAGGAGGAAAGAGcucgag-CUCUUUCCUCCUGUGCCAUCU |
| PPIB top shRNA 3 | 330 | AGCGCUUCCCCGAUGAGAACU-cucgagAGUUCUCAUCGGGGAAGCGCU |
| MALAT1 top shRNA 1 | 331 | AACAUAACAGACUUGGCCAAG-cucgagCUUGGCCAAGUCUGUUAUGUU |
| MALAT1 top shRNA 2 | 332 | AAGCUGAGUACAUUUUGCUGG-cucgagCCAGCAAAAUGUACUCAGCUU |
| MALAT1 top shRNA 3 | 333 | AAGUUAAUUGCUUGUCAAGCU-cucgagAGCUUGACAAGCAAUUAACUU |
| Gluc RNA seq shRNA 1 | 334 | AAAGUUCUGUUUGCCCUGAUCcucgag-GAUCAGGGCAAACAGAACUUU |
| KRAS RNA seq shRNA | 335 | UGUUACCUAAUUAUUACAGCC-cucgagGGCUGUAAUAAUUAGGUAACA |
| PPIB RNA seq shRNA | 336 | AACUCCUACCAACACUGACCA-cucgagUGGUCAGUGUUGGUAGGAGUU |
| Gluc RNA seq shRNA 2 | 337 | AACUUCGCGACCACGGAUCUC-cucgagGAGAUCCGUGGUCGCGAAGUU |

SUPPLEMENTARY TABLE 4 ssRNA targets used in this study

| Name | SEQ ID NO: | Guide sequence |
|---|---|---|
| ssRNA 1 | 338 | GGGGGCCAGUGAAUUCGAGCUCGGUACCCGGGGAUCCUCUAGAAAUAUGGAUUACUUGGUAGAACAGCAAUCUACUCGACCUGCAGGCAUGCAAGCUUGGCGUAAUCAUGGUCAUAGCUGUUUCCUGUGUUUAUCCGCUCACAAUUCCACACAACAUACGAGCCGGAAGCAUAAAG |
| ssRNA 2 | 339 | GGGUAGGUGUUCCACAGGGUAGCCAGCAGCAUCCUGCGAUGCAAAUAUGGAUUACUUGGUAGAACAGCAAUCUAAUCCGGAACAUAAUGGUGCAGGGCGCUGACUUCCGCGUUUCCAGACUUUACGAAACACGGAAACCGAAGACCAUUCAUGUUGUUGCUGCCGGAAGCAUAAAG |
| ssRNA 3 | 340 | GGGCCCCUCCGUUCGCGUUUACGCGGACGGUGAGACUGAAGAUAAUUGGAUUACUUGGUAGAACAGCAAUCUAAACUCAUUCUCUUUAAAAUAUCGUUCGAACUGGACUCCCGGUCGUUUUAACUCGACUGGGGCCAAAACGAAACAGUGGCACUACCCCGCCGGAAGCAUAAAG |
| Modified ssRNA 2 U | 341 | GGGUAGGUGUUCCACAGGGUAGCCAGCAGCAUCCUGCGAUGCAAAUAUGGAUUACUUGGUAGAACAGCAAUCUAAUCCGGAACAUAAUGGUGCAGGGCGCUGACUUCCGCGUUUGUUUUAAAUCAAACACGAAACCGAAGACCAUUCAUGUUGUUGCUGCCGGAAGCAUAAAG |
| Modified ssRNA 2 C | 342 | GGGUAGGUGUUCCACAGGGUAGCCAGCAGCAUCCUGCGAUGCAAAUAUGGAUUACUUGGUAGAACAGCAAUCUAAUCCGGAACAUAAUGGUGCAGGGCGCUGACUUCCGCGUUUGCCCCAACCAAACACGAAACCGAAGACCAUUCAUGUUGUUGCUGCCGGAAGCAUAAAG |
| Modified ssRNA 2 G | 343 | GGGUAGGUGUUCCACAGGGUAGCCAGCAGCAUCCUGCGAUGCAAAUAUGGAUUACUUGGUAGAACAGCAAUCUAAUCCGGAACAUAAUGGUGCAGGGCGCUGACUUCCGCGUUUGGGGGAAGCAAACACGAAACCGAAGACCAUUCAUGUUGUUGCUGCCGGAAGCAUAAAG |
| Modified ssRNA 2 A | 344 | GGGUAGGUGUUCCACAGGGUAGCCAGCAGCAUCCUGCGAUGCAAAUAUGGAUUACUUGGUAGAACAGCAAUCUAAUCCGGAACAUAAUGGUGCAGGGCGCUGACUUCCGCGUUUGAAAAAAACAAACACGAAACCGAAGACCAUUCAUGUUGUUGCUGCCGGAAGCAUAAAG |
| LwCas13a array | 345 | GGGGGAUUUAGACUACCCCAAAAACGAAGGGGACUAAAACUUUCUUUUCUUCGAUGUGGAUUGGUUUACCAGGAUUUAGACUACCCCAAAAACGAAGGGGACUAAAACGUAAAAUAGAUACAAUAACUUCUUCUACAUGAUUUAGACUACCCCAAAAACGAAGGGGACUAAAACgcgcg |

SUPPLEMENTARY TABLE 5

Guides used for in vitro experiments in this study.

| Name | SEQ ID NO: | Guide sequence |
|---|---|---|
| crRNA 1 | 346 | GGGGATTTAGACTAGCCCAAAAACGAAGGGGACTAAAACTAGATTGCTGTTCTACCAAGTAATCCAT |
| crRNA 1_29 | 347 | GGGGATTTAGACTACCCCAAAAACGAAGGGGACTAAAACTAGATTGCTGTTCTACCAAGTAATCCATA |

SUPPLEMENTARY TABLE 5-continued

Guides used for in vitro experiments in this study.

| Name | SEQ ID NO: | Guide sequence |
|---|---|---|
| crRNA 1_27 | 348 | GGGGATTTAGACTACCCCAAAAACGAAGGGGACTAAAACTAGATTGCTGTTCTACCAAGTAATCCA |
| crRNA 1_26 | 349 | GGGGATTTAGACTACCCCAAAAACGAAGGGGACTAAAACTAGATTGCTGTTCTACCAAGTAATCC |
| crRNA 1_25 | 350 | GGGGATTTAGACTACCCCAAAAACGAAGGGGACTAAAACTAGATTGCTGTTCTACCAAGTAATC |
| crRNA 1_24 | 351 | GGGGATTTAGACTACCCCAAAAACGAAGGGGACTAAAACTAGATTGCTGTTCTACCAAGTAAT |
| crRNA 1_23 | 352 | GGGGATTTAGACTACCCCAAAAACGAAGGGGACTAAAACTAGATTGCTGTTCTACCAAGTAA |
| crRNA 1_22 | 353 | GGGGATTTAGACTACCCCAAAAACGAAGGGGACTAAAACTAGATTGCTGTTCTACCAAGTA |
| crRNA 1_21 | 354 | GGGGATTTAGACTACCCCAAAAACGAAGGGGACTAAAACTAGATTGCTGTTCTACCAAGT |
| crRNA 1_20 | 355 | GGGGATTTAGACTACCCCAAAAACGAAGGGGACTAAAACTAGATTGCTGTTCTACCAAG |
| crRNA 1_19 | 356 | GGGGATTTAGACTACCCCAAAAACGAAGGGGACTAAAACTAGATTGCTGTTCTACCAA |
| crRNA 1_18 | 357 | GGGGATTTAGACTACCCCAAAAACGAAGGGGACTAAAACTAGATTGCTGTTCTACCA |
| crRNA 1_17 | 358 | GGGGATTTAGACTACCCCAAAAACGAAGGGGACTAAAACTAGATTGCTGTTCTACC |
| crRNA 1_16 | 359 | GGGGATTTAGACTACCCCAAAAACGAAGGGGACTAAAACTAGATTGCTGTTCTAC |
| crRNA 1_15 | 360 | GGGGATTTAGACTACCCCAAAAACGAAGGGGACTAAAACTAGATTGCTGTTCTA |
| crRNA 1_14 | 361 | GGGGATTTAGACTACCCCAAAAACGAAGGGGACTAAAACTAGATTGCTGTTCT |
| crRNA 1_13 | 362 | GGGGATTTAGACTACCCCAAAAACGAAGGGGACTAAAACTAGATTGCTGTTC |
| crRNA 1_12 | 363 | GGGGATTTAGACTACCCCAAAAACGAAGGGGACTAAAACTAGATTGCTGTT |
| crRNA 1_11 | 364 | GGGGATTTAGACTACCCCAAAAACGAAGGGGACTAAAACTAGATTGCTGT |
| crRNA 1_10 | 365 | GGGGATTTAGACTACCCCAAAAACGAAGGGGACTAAAACTAGATTGCTG |

SUPPLEMENTARY TABLE 6 ssRNA targets and crRNAs used for the SHERLOCK experiments.

| Name | SEQ ID NO: | Guide sequence |
|---|---|---|
| Cas13a Collateral detection guide length 28 | 366 | GGGGAUUUAGACUACCCCAAAAACGAAGGGGACUAAAACuagauugcuguucuaccaaguaauccau |
| Cas13a Collateral detection guide length 27 | 367 | GGGGAUUUAGACUACCCCAAAAACGAAGGGGACUAAAACuagauugcuguucuaccaaguaaucca |
| Cas13a Collateral detection guide length 26 | 368 | GGGGAUUUAGACUACCCCAAAAACGAAGGGGACUAAAACuagauugcuguucuaccaaguaaucc |
| Cas13a Collateral detection guide length 25 | 369 | GGGGAUUUAGACUACCCCAAAAACGAAGGGGACUAAAACuagauugcuguucuaccaaguaauc |
| Cas13a Collateral detection guide length 24 | 370 | GGGGAUUUAGACUACCCCAAAAACGAAGGGGACUAAAACuagauugcuguucuaccaaguaau |
| Cas13a Collateral detection guide length 23 | 371 | GGGGAUUUAGACUACCCCAAAAACGAAGGGGACUAAAACuagauugcuguucuaccaaguaa |
| Cas13a Collateral detection guide length 22 | 372 | GGGGAUUUAGACUACCCCAAAAACGAAGGGGACUAAAACuagauugcuguucuaccaagua |
| Cas13a Collateral detection guide length 21 | 373 | GGGGAUUUAGACUACCCCAAAAACGAAGGGGACUAAAACuagauugcuguucuaccaagu |
| Cas13a Collateral detection guide length 20 | 374 | GGGGAUUUAGACUACCCCAAAAACGAAGGGGACUAAAACuagauugcuguucuaccaag |
| Cas13a Collateral detection guide length 19 | 375 | GGGGAUUUAGACUACCCCAAAAACGAAGGGGACUAAAACuagauugcuguucuaccaa |
| Cas13a Collateral detection guide length 18 | 376 | GGGGAUUUAGACUACCCCAAAAACGAAGGGGACUAAAACuagauugcuguucuacca |

SUPPLEMENTARY TABLE 6-continued ssRNA targets and crRNAs used for the SHERLOCK experiments.

| Name | SEQ ID NO: | Guide sequence |
|---|---|---|
| Cas13a Collateral detection guide length 17 | 377 | GGGGAUUUAGACUACCCCAAAAACGAAGGGGACUAAAACuagauugcuguucuacc |
| Cas13a Collateral detection guide length 16 | 378 | GGGGAUUUAGACUACCCCAAAAACGAAGGGGACUAAAACuagauugcuguucuac |
| Cas13a Collateral detection guide length 15 | 379 | GGGGAUUUAGACUACCCCAAAAACGAAGGGGACUAAAACuagauugcuguucua |
| Cas13a Collateral detection guide Full length mismatch 1 | 380 | GGGGAUUUAGACUACCCCAAAAACGAAGGGGACUAAAAC<u>A</u>agauugcuguucuaccaaguaauccau |
| Cas13a Collateral detection guide Full length mismatch 3 | 381 | GGGGAUUUAGACUACCCCAAAAACGAAGGGGACUAAAACua<u>C</u>auugcuguucuaccaaguaauccau |
| Cas13a Collateral detection guide Full length mismatch 5 | 382 | GGGGAUUUAGACUACCCCAAAAACGAAGGGGACUAAAACuaga<u>A</u>ugcuguucuaccaaguaauccau |
| Cas13a Collateral detection guide Full length mismatch 7 | 383 | GGGGAUUUAGACUACCCCAAAAACGAAGGGGACUAAAACuagauu<u>C</u>cguucuaccaaguaauccau |
| Cas13a Collateral detection guide Full length mismatch 9 | 384 | GGGGAUUUAGACUACCCCAAAAACGAAGGGGACUAAAACuagauugc<u>A</u>guucuaccaaguaauccau |
| Cas13a Collateral detection guide Full length mismatch 11 | 385 | GGGGAUUUAGACUACCCCAAAAACGAAGGGGACUAAAACuagauugcug<u>A</u>ucuaccaaguaauccau |
| Cas13a Collateral detection guide Full length mismatch 13 | 386 | GGGGAUUUAGACUACCCCAAAAACGAAGGGGACUAAAACuagauugcuguu<u>G</u>uaccaaguaauccau |
| Cas13a Collateral detection guide Full length mismatch 15 | 387 | GGGGAUUUAGACUACCCCAAAAACGAAGGGGACUAAAACuagauugcuguucu<u>U</u>ccaaguaauccau |
| Cas13a Collateral detection guide Full length mismatch 17 | 388 | GGGGAUUUAGACUACCCCAAAAACGAAGGGGACUAAAACuagauugcuguucuac<u>G</u>aaguaauccau |
| Cas13a Collateral detection guide Full length mismatch 19 | 389 | GGGGAUUUAGACUACCCCAAAAACGAAGGGGACUAAAACuagauugcuguucuacca<u>U</u>guaauccau |
| Target 1 | 390 | gggGGCCAGUGAAUUCGAGCUCGGUACCCGGGGAUCCUCUAGAAAUAUGGAUUACUUGGUAGAACAGCAAUCUACUCGACCUGCAGGCAUGCAAGCUUGGCGUAAUCAUGGUCAUAGCUGUUUCCUGUGUUUAUCCGCUCACAAUUCCACACAACAUACGAGCCGGAAGCAUAAAG |
| Target 2 | 391 | gggGGCCAGUGAAUUCGAGCUCGGUACCCGGGGAUCCUCUAGAAAUAUGGAUUACUUGGUAGAACAGCAAUGUACUCGACCUGCAGGCAUGCAAGCUUGGCGUAAUCAUGGUCAUAGCUGUUUCCUGUGUUUAUCCGCUCACAAUUCCACACAACAUACGAGCCGGAAGCAUAAAG |

SUPPLEMENTARY TABLE 7

Commercial TaqMan probes used in this study.

| Transcript | Product ID (Thermo Fisher) |
|---|---|
| GAPDH | 4326317E |
| KRAS | Hs00364284_g1 |
| PPIB | Hs00168719_m1 |
| CXCR4 | Hs00607978_s1 |
| ACTB | Hs01060665_g1 |
| TINCR | Hs00542141_m1 |
| PCAT | Hs04275836_s1 |
| MALAT1 | Hs00273907_s1 |

SUPPLEMENTARY TABLE 8

Custom TaqMan probes used in this study.

| Gene | Probe sequence | Forward Primer | Reverse Primer |
|---|---|---|---|
| Gluc | /56-FAM/CCAAGCCCA/ZEN/CCGAGAACAACGA/3IABkFQ/ (SEQ ID NO: 392) | AAGTTCTGTTTGCCCTGATCT (SEQ ID NO: 393) | GGCCACGATGTTGAAGTCT (SEQ ID NO: 394) |

SUPPLEMENTARY TABLE 9

Cas13a orthologs used in this study.

| Cas13a number | Cas13a abbreviation | Organism name | Accession number | SEQ ID NO: | Direct Repeat sequence |
|---|---|---|---|---|---|
| Cas13a1 | LshCas13a | Leptotrichia shahii | WP_018451595.1 | 395 | CCACCCCAATATCGAAGGGGACTAAAAC |
| Cas13a2 | LwaCas13a | Leptotrichia wadei | WP_021746774.1 | 396 | GATTTAGACTACCCCAAAAACGAAGGGGACTAAAAC |
| Cas13a3 | LseCas13a | Listeria seeligeri | WP_012985477.1 | 397 | GTAAGAGACTACCTCTATATGAAAGAGGACTAAAAC |
| Cas13a4 | LbmCas13a | Lachnospiraceae bacterium MA2020 | WP_044921188.1 | 398 | GTATTGAGAAAAGCCAGATATAGTTGGCAATAGAC |
| Cas13a5 | LbnCas13a | Lachnospiraceae bacterium NK4A179 | WP_022785443.1 | 399 | GTTGATGAGAAGAGCCCAAGATAGAGGGCAATAAC |
| Cas13a6 | CamCas13a | [Clostridium] aminophilum DSM 10710 | WP_031473346.1 | 400 | GTCTATTGCCCTCTATATCGGGCTGTTCTCCAAAC |
| Cas13a7 | CgaCas13a | Carnobacterium gallinarum DSM 4847 | WP_034560163.1 | 401 | ATTAAAGACTACCTCTAAATGTAAGAGGACTAAAC |
| Cas13a8 | Cga2Cas13a | Carnobacterium gallinarum DSM 4847 | WP_034563842.1 | 402 | AATATAAACTACCTCTAAATGTAAGAGGACTAAAC |
| Cas13a9 | Pprcas13a | Paludibacter propionicigenes WB4 | WP_013443710.1 | 403 | CTTGTGGATTATCCCAAAATTGAAGGGAACTACAAC |
| Cas13a10 | LweCas13a | Listeria weihenstephanensis FSL R9-0317 | WP_036059185.1 | 404 | GATTTAGAGTACCTCAAAATAGAAGAGGTCTAAAAC |
| Cas13a11 | LbfCas13a | Listeriaceae bacterium FSL M6-0635 (Listeria newyorkensis) | WP_036091002.1 | 405 | GATTTAGAGTACCTCAAAACAAAAGAGGACTAAAAC |
| Cas13a12 | Lwa2cas13a | Leptotrichia wadei F0279 | WP_021746774.1 | 406 | GATATAGATAACCCCAAAAACGAAGGGATCTAAAAC |
| Cas13a13 | RcsCas13a | Rhodobacter capsulatus SB 1003 | WP_013067728.1 | 407 | GCCTCACATCACCGCCAAGACGACGGCGGACTGAAC |
| Cas13a14 | RcrCas13a | Rhodobacter capsulatus R121 | WP_023911507.1 | 408 | GCCTCACATCACCGCCAAGACGACGGCGGACTGAAC |
| Cas13a15 | RcdCas13a | Rhodobacter capsulatus DE442 | WP_023911507.1 | 409 | GCCTCACATCACCGCCAAGACGACGGCGGACTGAAC |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (577 sequences)

SEQ ID NO: 1 - DNA, 28 bp, Artificial Sequence
  Synthetic
atcagggcaaacagaactttgactccca

SEQ ID NO: 2 - DNA, 28 bp, Artificial Sequence
  Synthetic
agatccgtggtcgcgaagttgctggcca

SEQ ID NO: 3 - DNA, 28 bp, Artificial Sequence
  Synthetic
tcgccttcgtaggtgtggcagcgtcctg

SEQ ID NO: 4 - DNA, 28 bp, Artificial Sequence
  Synthetic
tagattgctgttctaccaagtaatccat

SEQ ID NO: 5 - DNA, 28 bp, Artificial Sequence
  Synthetic
tcgccttcgtaggtgtggcagcgtcctg

SEQ ID NO: 6 - DNA, 28 bp, Artificial Sequence
  Synthetic
tagattgctgttctaccaagtaatccat

SEQ ID NO: 7 - DNA, 28 bp, Artificial Sequence
  Synthetic
tgaacagctcctcgcccttgctcaccat

SEQ ID NO: 8 - DNA, 28 bp, Artificial Sequence
  Synthetic
tcagcttgccgtaggtggcatcgccctc

SEQ ID NO: 9 - DNA, 28 bp, Artificial Sequence
  Synthetic
gggtagcggctgaagcactgcacgccgt

SEQ ID NO: 10 - DNA, 28 bp, Artificial Sequence
  Synthetic
ggtcttgtagttgccgtcgtccttgaag

SEQ ID NO: 11 - DNA, 28 bp, Artificial Sequence
  Synthetic
tactccagcttgtgccccaggatgttgc

SEQ ID NO: 12 - DNA, 28 bp, Artificial Sequence
  Synthetic
cacgctgccgtcctcgatgttgtggcgg

SEQ ID NO: 13 - DNA, 28 bp, Artificial Sequence
  Synthetic
tctttgctcagggcggactgggtgctca

SEQ ID NO: 14 - DNA, 28 bp, Artificial Sequence
  Synthetic
gacttgtacagctcgtccatgccgagag

SEQ ID NO: 15 - DNA, 28 bp, Artificial Sequence
  Synthetic
ctgctgccacagaccgagaggcttaaaa

SEQ ID NO: 16 - DNA, 28 bp, Artificial Sequence
  Synthetic
tccttgattacacgatggaatttgctgt

SEQ ID NO: 17 - DNA, 28 bp, Artificial Sequence
  Synthetic
tcaaggtggggtcacaggagaagccaaa

SEQ ID NO: 18 - DNA, 28 bp, Artificial Sequence
  Synthetic
atgataatgcaatagcaggacaggatga

SEQ ID NO: 19 - DNA, 28 bp, Artificial Sequence
  Synthetic
gcgtgagccaccgcgcctggccggctgt

SEQ ID NO: 20 - DNA, 28 bp, Artificial Sequence
  Synthetic
ccagctgcagatgctgcagtttttggcg

SEQ ID NO: 21 - DNA, 28 bp, Artificial Sequence
  Synthetic
ctggaaatggaagatgccggcatagcca

SEQ ID NO: 22 - DNA, 28 bp, Artificial Sequence
  Synthetic
gatgacacctcacacggaccacccctag

SEQ ID NO: 23 - DNA, 28 bp, Artificial Sequence
  Synthetic
taatactgctccagatatgggtgggcca

SEQ ID NO: 24 - DNA, 28 bp, Artificial Sequence
  Synthetic
catgaagaccgagttatagaatactata

SEQ ID NO: 25 - DNA, 28 bp, Artificial Sequence
  Synthetic
ggtgaaatattctccatccagtggtttc

SEQ ID NO: 26 - DNA, 28 bp, Artificial Sequence
  Synthetic
aatttctcgaactaatgtatagaaggca

SEQ ID NO: 27 - protein, 7 aa, Simian virus 40
PKKKRKV

SEQ ID NO: 28 - protein, 16 aa, Artificial Sequence
  Synthetic
KRPAATKKAGQAKKKK

SEQ ID NO: 29 - protein, 9 aa, Homo sapiens
PAAKRVKLD

SEQ ID NO: 30 - protein, 11 aa, Homo sapiens
RQRRNELKRSP

SEQ ID NO: 31 - protein, 38 aa, Homo sapiens
NQSSNFGPMKGGNFGGRSSGPYGGGGQYFAKPRNQGGY

SEQ ID NO: 32 - protein, 42 aa, Homo sapiens
RMRIZFKNKGKDTAELRRRRVEVSVELRKAKKDEQILKRRNV

SEQ ID NO: 33 - protein, 8 aa, Homo sapiens
VSRKRPRP

SEQ ID NO: 34 - protein, 8 aa, Homo sapiens
PPKKARED

SEQ ID NO: 35 - protein, 8 aa, Homo sapiens
PQPKKKPL

SEQ ID NO: 36 - protein, 12 aa, Mus sp.
SALIKKKKKMAP

SEQ ID NO: 37 - protein, 5 aa, Influenza virus
DRLRR

SEQ ID NO: 38 - protein, 7 aa, Influenza virus
PKQKKRK

SEQ ID NO: 39 - protein, 10 aa, Hepatitis D virus
RKLKKKIKKL

SEQ ID NO: 40 - protein, 10 aa, Mus sp.
REKKKFLKRR

SEQ ID NO: 41 - protein, 20 aa, Homo sapiens
KRKGDEVDGVDEVAKKKSKK

SEQ ID NO: 42 - protein, 17 aa, Homo sapiens
RKCLQAGMNLEARKTKK

SEQ ID NO: 43 - protein, 11 aa, Artificial Sequence
  Synthetic
LYPERLRRILT

SEQ ID NO: 44 - DNA, 33 bp, Artificial Sequence
  Synthetic
ctgtaccctgagcggctgcggcggatcctgacc

SEQ ID NO: 45 - protein, 1001 aa, Artificial Sequence
  Synthetic
  MISC_FEATURE (1)..(1001): Variant residues given in the sequence have no preference with respect to those in the annotations for variant positions
  MOD_RES (7)..(9): Any amino acid
  MOD_RES (11)..(11): Any amino acid
  MOD_RES (14)..(16): Any amino acid
  MOD_RES (20)..(20): Any amino acid
  MOD_RES (22)..(22): Any amino acid
  MOD_RES (29)..(29): Any amino acid
  MOD_RES (36)..(36): Any amino acid
  MOD_RES (42)..(43): Any amino acid
  MOD_RES (48)..(48): Any amino acid
  MOD_RES (52)..(53): Any amino acid
  MOD_RES (57)..(57): Any amino acid
  MOD_RES (59)..(59): Any amino acid
  MOD_RES (69)..(71): Any amino acid
  MOD_RES (73)..(73): Any amino acid
  MOD_RES (75)..(75): Any amino acid
  MOD_RES (78)..(79): Any amino acid
  MOD_RES (86)..(86): Any amino acid
  MOD_RES (89)..(89): Any amino acid
  VARIANT (90)..(90): /replace="Ile"
  MOD_RES (101)..(101): Any amino acid
  MOD_RES (104)..(104): Any amino acid
  MOD_RES (111)..(111): Any amino acid
  MOD_RES (116)..(116): Any amino acid
  MOD_RES (121)..(121): Any amino acid
  MOD_RES (128)..(130): Any amino acid
  MOD_RES (133)..(133): Any amino acid
  MOD_RES (145)..(145): Any amino acid
  MOD_RES (148)..(148): Any amino acid
  MOD_RES (167)..(167): Any amino acid
  MOD_RES (174)..(174): Any amino acid
  MOD_RES (192)..(192): Any amino acid
  MOD_RES (194)..(195): Any amino acid
  MOD_RES (199)..(199): Any amino acid
  MOD_RES (202)..(203): Any amino acid
  MOD_RES (206)..(206): Any amino acid
  MOD_RES (217)..(219): Any amino acid
  MOD_RES (228)..(228): Any amino acid
  MOD_RES (233)..(233): Any amino acid
  VARIANT (236)..(236): /replace="Ile"
  MOD_RES (243)..(243): Any amino acid
  MOD_RES (245)..(245): Any amino acid
  MOD_RES (262)..(262): Any amino acid
  VARIANT (267)..(267): /replace="Ile"
  MOD_RES (277)..(278): Any amino acid
  MOD_RES (282)..(282): Any amino acid
  MOD_RES (287)..(287): Any amino acid
  MOD_RES (307)..(307): Any amino acid
  MOD_RES (314)..(314): Any amino acid
  MOD_RES (320)..(321): Any amino acid
  MOD_RES (333)..(333): Any amino acid
  MOD_RES (343)..(343): Any amino acid
  MOD_RES (357)..(357): Any amino acid
  MOD_RES (367)..(367): Any amino acid
  MOD_RES (371)..(371): Any amino acid
  MOD_RES (374)..(375): Any amino acid
  MOD_RES (378)..(378): Any amino acid
  MOD_RES (392)..(392): Any amino acid
  MOD_RES (402)..(402): Any amino acid
  MOD_RES (414)..(415): Any amino acid
  VARIANT (418)..(418): /replace="Ile"
  MOD_RES (446)..(446): Any amino acid
  MOD_RES (448)..(449): Any amino acid
  MOD_RES (451)..(451): Any amino acid
  MOD_RES (467)..(467): Any amino acid
  MOD_RES (489)..(489): Any amino acid
  MOD_RES (500)..(500): Any amino acid
  MOD_RES (510)..(510): Any amino acid
  MOD_RES (514)..(514): Any amino acid
  MOD_RES (528)..(529): Any amino acid
  MOD_RES (532)..(532): Any amino acid
  MOD_RES (539)..(539): Any amino acid
  MOD_RES (547)..(548): Any amino acid
  MOD_RES (551)..(551): Any amino acid
  MOD_RES (553)..(554): Any amino acid
  MOD_RES (565)..(565): Any amino acid
  MOD_RES (576)..(576): Any amino acid
  MOD_RES (587)..(588): Any amino acid
  MOD_RES (600)..(600): Any amino acid
  MOD_RES (604)..(605): Any amino acid
  MOD_RES (622)..(622): Any amino acid
  MOD_RES (627)..(627): Any amino acid
  MOD_RES (629)..(629): Any amino acid
  MOD_RES (655)..(655): Any amino acid
  MOD_RES (662)..(662): Any amino acid
  MOD_RES (682)..(682): Any amino acid
  MOD_RES (686)..(686): Any amino acid
  VARIANT (688)..(688): /replace="Ile"
  MOD_RES (691)..(691): Any amino acid
  MOD_RES (698)..(698): Any amino acid
  MOD_RES (706)..(706): Any amino acid
  MOD_RES (723)..(723): Any amino acid
  VARIANT (737)..(737): /replace="Ile"
  MOD_RES (738)..(738): Any amino acid
  MOD_RES (760)..(761): Any amino acid
  MOD_RES (771)..(771): Any amino acid
  MOD_RES (773)..(773): Any amino acid
  MOD_RES (779)..(779): Any amino acid
  MOD_RES (786)..(786): Any amino acid
  MOD_RES (790)..(790): Any amino acid
  MOD_RES (798)..(798): Any amino acid
  MOD_RES (800)..(800): Any amino acid
  MOD_RES (834)..(834): Any amino acid
  MOD_RES (843)..(843): Any amino acid
  MOD_RES (851)..(852): Any amino acid
  MOD_RES (866)..(866): Any amino acid
  MOD_RES (870)..(870): Any amino acid
  MOD_RES (873)..(873): Any amino acid
  MOD_RES (877)..(877): Any amino acid
  MOD_RES (889)..(889): Any amino acid
  MOD_RES (896)..(896): Any amino acid
  MOD_RES (916)..(916): Any amino acid
  MOD_RES (923)..(923): Any amino acid
  MOD_RES (936)..(936): Any amino acid
  MOD_RES (962)..(962): Any amino acid
  MOD_RES (966)..(966): Any amino acid
  MOD_RES (970)..(970): Any amino acid
  MOD_RES (985)..(985): Any amino acid
  MOD_RES (996)..(996): Any amino acid
MKISKVXXXVXKKXXXGKLXKXVNERNRXAKRLSNXLBKYIXXIDKIXKKEXXKKFXAXEEITLKLNQXXXBXLXKAXXDLRKDNXYSXLKKILHNEDINXEEXELLINDXLEKLXKIESXKYSYQKXXXNYXMSVQEHSKKSIXRIXESAKRNKEALDKFLKEYAXLDPRMEXLAKLRKLLELYFYFKNDXIXXEEEXNVXXHKXLKENHPDFVEXXXNKENAELNXYAIEXKKLLKYYFPXKXAKNSNDKIFEKQELKKXWIHQLENAVERILLXXGKVXYKLQXGYLAELWKIRINEIFIKYIXVGKAVAXFALRNXXKBENDILGGKIXKKLNGITSFXYEKIKAEEILQREXAVEVAFAANXLYAXDLXXIRXSILQFFGGASNWDXFLFFHFATSXISDKKWNAELIXXKKLGLVIREKLYSNNVAMFYSKDDLEKLLNXLXXFXLRASQVPSFKKVYVRXBFPQNLLKKFNDEKDDEAYSAXYYLLKEIYYNXFLPYFSANNXFFFXVKNLVLKANKDKFXXAFXDIREMNXGSPIEYLXXTQXNXXNEGRKKEEKEXDFIKFLLQIFXKGFDDYLKNNXXFILKFIPEPTEXIEIXXELQAWYIVGKFLNARKXNLLGXFXSYLKLLDDIELRALRNENIKYQSSNXEKEVLEXCLELIGLLSLDLNDYFBDEXDFAXYLGKXLDFEKKXMKDLAELXPYDQNDGENPIVNRNIXLAKKYGTLNLLEKLXDKVSEKEIKEYYELKKEIEEYXXKGEELHEEWXQXKNRVEXRDILEYXEELXGQIINYNXLXNKVLLYFQLGLHYLLLDILGRLVGYTGIWERDAXLYQIAAMYXNGLPEYIXXKKNDKYKDGQIVGXKINXFKXDKKXLYNAGLELFENXNEHKNIXIRNYIAHFNYLSKAESSLLXYSENLRXLFSYDRKLKNAVXKSLINILLRHGMVLKFKFGTDKKSVXIRSXKKIXHLKSIAKKLYYPEVXVSKEYCKLVKXLLKYK

SEQ ID NO: 46 - protein, 15 aa, Artificial Sequence
  Synthetic
GGGGSGGGGSGGGGS

SEQ ID NO: 47 - protein, 4 aa, Artificial Sequence
  Synthetic
KDEL

SEQ ID NO: 48 - protein, 4 aa, Artificial Sequence
  Synthetic
GGGS

SEQ ID NO: 49 - protein, 30 aa, Artificial Sequence
  Synthetic
GGGGSGGGGSGGGGSGGGGSGGGGSGGGGS

SEQ ID NO: 50 - protein, 45 aa, Artificial Sequence
  Synthetic
GGGGSGGGGSGGGGSGGGGSGGGGSGGGGSGGGGSGGGGSGGGGS

SEQ ID NO: 51 - protein, 60 aa, Artificial Sequence
  Synthetic
GGGGSGGGGSGGGGSGGGGSGGGGSGGGGSGGGGSGGGGSGGGGSGGGGSGGGGSGGGGS

SEQ ID NO: 52 - protein, 12 aa, Artificial Sequence
  Synthetic
  MOD_RES (2)..(2): Aminohexanoyl
  MOD_RES (5)..(5): Aminohexanoyl
  MOD_RES (8)..(8): Aminohexanoyl
  MOD_RES (11)..(11): Aminohexanoyl
RXRRXRRXRRXR

SEQ ID NO: 53 - DNA, 20 bp, Homo sapiens
gagtccgagcagaagaagaa

SEQ ID NO: 54 - DNA, 20 bp, Homo sapiens
gagtcctagcaggagaagaa

SEQ ID NO: 55 - DNA, 20 bp, Homo sapiens
gagtctaagcagaagaagaa

SEQ ID NO: 56 - RNA, 25 nt, Artificial Sequence
  Synthetic
gggaacaaagcugaaguacuuaccc

SEQ ID NO: 57 - RNA, 12 nt, Artificial Sequence
  Synthetic
  MISC_FEATURE (1)..(1): /5Biosg/ indicates a biotin tag
  MISC_FEATURE (12)..(12): /3IAbRQSp/ indicates an Iowa black quencher
ucucguacguuc

SEQ ID NO: 58 - RNA, 24 nt, Artificial Sequence
  Synthetic
  MISC_FEATURE (1)..(1): /5Biosg/ indicates a biotin tag
  MISC_FEATURE (24)..(24): /3IAbRQSp/ indicates an Iowa black quencher
ucucguacguucucucguacguuc

SEQ ID NO: 59 - protein, 1340 aa, Lachnospiraceae bacterium MA2020
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 60 - protein, 1437 aa, Lachnospiraceae bacterium NK4A179
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 61 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 62 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 63 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 64 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 65 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 66 - protein, 1051 aa, Listeriaceae bacterium
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 67 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 68 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 69 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 70 - protein, 1285 aa, Rhodobacter capsulatus; identical to SEQ ID NO: 69

SEQ ID NO: 71 - protein, 1389 aa, Artificial Sequence
  Synthetic
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 72 - protein, 1197 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 73 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 74 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 75 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 76 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 77 - protein, 1373 aa, Eubacteriaceae bacterium CHKCI004
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 78 - protein, 1276 aa, Blautia sp. Marseille-P2398
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 79 - protein, 1385 aa, Leptotrichia sp. oral taxon 879
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 80 - protein, 1334 aa, Lachnospiraceae bacterium NK4A144
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 81 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 82 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 83 - protein, 1235 aa, Thalassospira sp. TSL5-1
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 84 - protein, 1312 aa, Pseudobutyrivibrio sp. OR37
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 85 - protein, 1343 aa, Butyrivibrio sp. YAB3001
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 86 - protein, 1276 aa, Blautia sp. Marseille-P2398; identical to SEQ ID NO: 78

SEQ ID NO: 87 - protein, 1168 aa, Leptotrichia massiliensis Marseille-P3007
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 88 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 89 - protein, 697 aa, Porphyromonadaceae bacterium KH3CP3RA
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 90 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 91 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 92 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 93 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 94 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 95 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 96 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 97 - protein, 953 aa, Alistipes sp. ZOR0009
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 98 - protein, 1322 aa, Prevotella sp. MA2016
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 99 - protein, 1322 aa, Prevotella sp. MA2016; identical to SEQ ID NO: 98

SEQ ID NO: 100 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 101 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 102 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 103 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 104 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 105 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 106 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 107 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 108 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 109 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 110 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 111 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 112 - protein, 1175 aa, Porphyromonas sp. COT-052 OH4946
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 113 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 114 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 115 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 116 - protein, 1127 aa, Prevotella buccae; identical to SEQ ID NO: 94

SEQ ID NO: 117 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 118 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 119 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 120 - protein, 1224 aa, Bergeyella zoohelcum; identical to SEQ ID NO: 92

SEQ ID NO: 121 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 122 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 123 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 124 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 125 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 126 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 127 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 128 - protein, 1161 aa, Bacteroidetes bacterium GWA2_31_9
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 129 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 130 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 131 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 132 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 133 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 134 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 135 - protein, 1125 aa, Prevotella pallens; identical to SEQ ID NO: 117

SEQ ID NO: 136 - protein, 1157 aa, Myroides odoratimimus; identical to SEQ ID NO: 118

SEQ ID NO: 137 - protein, 1157 aa, Myroides odoratimimus; identical to SEQ ID NO: 119

SEQ ID NO: 138 - protein, 1127 aa, Prevotella sp. MSX73
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 139 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 140 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 141 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 142 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 143 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 144 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 145 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 146 - protein, 1135 aa, Porphyromonas gingivalis; identical to SEQ ID NO: 124

SEQ ID NO: 147 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 148 - protein, 1135 aa, Porphyromonas gingivalis; identical to SEQ ID NO: 125

SEQ ID NO: 149 - protein, 1135 aa, Porphyromonas gingivalis; identical to SEQ ID NO: 126

SEQ ID NO: 150 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 151 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 152 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 153 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 154 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 155 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 156 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 157 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 158 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 159 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 160 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 161 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 162 - protein, 1090 aa, Prevotella sp. P5-119
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 163 - protein, 1090 aa, Prevotella pectinovora
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 164 - protein, 1090 aa, Prevotella pectinovora
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 165 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 166 - protein, 1155 aa, Flavobacterium sp. 316
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 167 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 168 - protein, 1145 aa, Chryseobacterium sp. YR477
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 169 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 170 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 171 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 172 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 173 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 174 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 175 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 176 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 177 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 178 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 179 - protein, 1133 aa, Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 180 - protein, 1816 aa, Artificial Sequence
  Synthetic
  MISC_FEATURE (1)..(1816)
  MISC_FEATURE (1)..(1816): Variant residues given in the sequence have no preference with respect to those in the annotations for variant positions
  MOD_RES (30)..(30): Any amino acid
  MOD_RES (33)..(33): Any amino acid
  MOD_RES (38)..(38): Any amino acid
  MOD_RES (41)..(41): Any amino acid
  MOD_RES (43)..(43): Any amino acid
  MOD_RES (45)..(45): Any amino acid
  MOD_RES (49)..(49): Any amino acid
  MOD_RES (73)..(73): Any amino acid
  MOD_RES (85)..(86): Any amino acid
  MOD_RES (102)..(102): Any amino acid
  MOD_RES (105)..(108): Any amino acid
  MOD_RES (138)..(139): Any amino acid
  MOD_RES (143)..(143): Any amino acid
  MOD_RES (146)..(148): Any amino acid
  MOD_RES (153)..(158): Any amino acid
  MOD_RES (160)..(160): Any amino acid
  MOD_RES (180)..(180): Any amino acid
  MOD_RES (183)..(183): Any amino acid
  MOD_RES (189)..(189): Any amino acid
  VARIANT (195)..(195): /replace="Ile"
  MOD_RES (196)..(196): Any amino acid
  MOD_RES (198)..(199): Any amino acid
  MOD_RES (203)..(204): Any amino acid
  MOD_RES (212)..(212): Any amino acid
  MOD_RES (214)..(214): Any amino acid
  MOD_RES (217)..(217): Any amino acid
  MOD_RES (220)..(220): Any amino acid
  MOD_RES (228)..(228): Any amino acid
  MOD_RES (234)..(235): Any amino acid
  MOD_RES (241)..(243): Any amino acid
  MOD_RES (249)..(249): Any amino acid
  MOD_RES (255)..(255): Any amino acid
  MOD_RES (257)..(257): Any amino acid
  MOD_RES (268)..(268): Any amino acid
  MOD_RES (270)..(270): Any amino acid
  VARIANT (271)..(271): /replace="Ile"
  MOD_RES (272)..(272): Any amino acid
  MOD_RES (293)..(293): Any amino acid
  MOD_RES (301)..(302): Any amino acid
  MOD_RES (304)..(304): Any amino acid
  MOD_RES (311)..(312): Any amino acid
  MOD_RES (317)..(318): Any amino acid
  MOD_RES (325)..(326): Any amino acid
  MOD_RES (328)..(328): Any amino acid
  MOD_RES (336)..(336): Any amino acid
  MOD_RES (338)..(338): Any amino acid
  MOD_RES (342)..(344): Any amino acid
  MOD_RES (346)..(347): Any amino acid
  MOD_RES (349)..(350): Any amino acid
  MOD_RES (359)..(359): Any amino acid
  MOD_RES (361)..(361): Any amino acid
  MOD_RES (363)..(363): Any amino acid
  MOD_RES (371)..(371): Any amino acid
  MOD_RES (377)..(378): Any amino acid
  MOD_RES (391)..(391): Any amino acid
  MOD_RES (402)..(403): Any amino acid
  MOD_RES (406)..(406): Any amino acid
  MOD_RES (416)..(418): Any amino acid
  MOD_RES (422)..(423): Any amino acid
  MOD_RES (425)..(425): Any amino acid
  MOD_RES (427)..(427): Any amino acid
  MOD_RES (429)..(429): Any amino acid
  MOD_RES (433)..(434): Any amino acid
  MOD_RES (436)..(436): Any amino acid
  MOD_RES (438)..(438): Any amino acid
  MOD_RES (440)..(441): Any amino acid
  MOD_RES (444)..(444): Any amino acid
  MOD_RES (446)..(446): Any amino acid
  MOD_RES (449)..(450): Any amino acid
  MOD_RES (457)..(458): Any amino acid
  VARIANT (459)..(459): /replace="Ile"
  MOD_RES (469)..(469): Any amino acid
  MOD_RES (474)..(475): Any amino acid
  MOD_RES (481)..(482): Any amino acid
  MOD_RES (486)..(486): Any amino acid
  MOD_RES (489)..(489): Any amino acid
  MOD_RES (492)..(492): Any amino acid
  MOD_RES (497)..(499): Any amino acid
  MOD_RES (504)..(504): Any amino acid
  MOD_RES (506)..(507): Any amino acid
  MOD_RES (510)..(510): Any amino acid
  MOD_RES (514)..(514): Any amino acid
  MOD_RES (530)..(530): Any amino acid
  MOD_RES (532)..(533): Any amino acid
  MOD_RES (540)..(541): Any amino acid
  MOD_RES (546)..(546): Any amino acid
  MOD_RES (555)..(555): Any amino acid
  MOD_RES (560)..(560): Any amino acid
  MOD_RES (580)..(580): Any amino acid
  MOD_RES (583)..(583): Any amino acid
  MOD_RES (585)..(585): Any amino acid
  MOD_RES (593)..(594): Any amino acid
  MOD_RES (604)..(604): Any amino acid
  MOD_RES (611)..(611): Any amino acid
  MOD_RES (613)..(614): Any amino acid
  MOD_RES (631)..(631): Any amino acid
  MOD_RES (634)..(634): Any amino acid
  MOD_RES (644)..(644): Any amino acid
  MOD_RES (646)..(646): Any amino acid
  MOD_RES (648)..(648): Any amino acid
  MOD_RES (650)..(650): Any amino acid
  MOD_RES (652)..(652): Any amino acid
  MOD_RES (671)..(671): Any amino acid
  MOD_RES (675)..(677): Any amino acid
  MOD_RES (679)..(679): Any amino acid
  MOD_RES (681)..(682): Any amino acid
  MOD_RES (697)..(697): Any amino acid
  MOD_RES (703)..(703): Any amino acid
  MOD_RES (713)..(716): Any amino acid
  MOD_RES (721)..(721): Any amino acid
  MOD_RES (725)..(726): Any amino acid
  MOD_RES (729)..(729): Any amino acid
  MOD_RES (734)..(737): Any amino acid
  MOD_RES (739)..(739): Any amino acid
  MOD_RES (742)..(743): Any amino acid
  MOD_RES (745)..(747): Any amino acid
  MOD_RES (751)..(753): Any amino acid
  MOD_RES (760)..(760): Any amino acid
  MOD_RES (763)..(764): Any amino acid
  MOD_RES (766)..(767): Any amino acid
  MOD_RES (770)..(771): Any amino acid
  MOD_RES (783)..(783): Any amino acid
  MOD_RES (788)..(788): Any amino acid
  MOD_RES (808)..(808): Any amino acid
  MOD_RES (812)..(812): Any amino acid
  MOD_RES (814)..(814): Any amino acid
  MOD_RES (816)..(816): Any amino acid
  MOD_RES (826)..(826): Any amino acid
  MOD_RES (838)..(840): Any amino acid
  MOD_RES (843)..(843): Any amino acid
  MOD_RES (847)..(847): Any amino acid
  MOD_RES (851)..(851): Any amino acid
  MOD_RES (856)..(856): Any amino acid
  MOD_RES (859)..(859): Any amino acid
  MOD_RES (861)..(861): Any amino acid
  MOD_RES (873)..(873): Any amino acid
  MOD_RES (878)..(878): Any amino acid
  MOD_RES (882)..(884): Any amino acid
  MOD_RES (889)..(892): Any amino acid
  MOD_RES (898)..(900): Any amino acid
  MOD_RES (903)..(903): Any amino acid
  MOD_RES (908)..(909): Any amino acid
  MOD_RES (912)..(912): Any amino acid
  MOD_RES (915)..(915): Any amino acid
  MOD_RES (918)..(918): Any amino acid
  MOD_RES (932)..(932): Any amino acid
  MOD_RES (934)..(935): Any amino acid
  MOD_RES (939)..(939): Any amino acid
  MOD_RES (941)..(941): Any amino acid
  MOD_RES (944)..(944): Any amino acid
  MOD_RES (946)..(946): Any amino acid
  MOD_RES (951)..(951): Any amino acid
  MOD_RES (961)..(961): Any amino acid
  MOD_RES (963)..(963): Any amino acid
  MOD_RES (965)..(965): Any amino acid
  MOD_RES (980)..(980): Any amino acid
  MOD_RES (988)..(988): Any amino acid
  MOD_RES (992)..(993): Any amino acid
  MOD_RES (1001)..(1001): Any amino acid
  MOD_RES (1003)..(1003): Any amino acid
  MOD_RES (1005)..(1005): Any amino acid
  MOD_RES (1019)..(1019): Any amino acid
  VARIANT (1021)..(1021): /replace="Ile"
  MOD_RES (1023)..(1023): Any amino acid
  MOD_RES (1025)..(1025): Any amino acid
  MOD_RES (1029)..(1029): Any amino acid
  MOD_RES (1033)..(1033): Any amino acid
  MOD_RES (1048)..(1049): Any amino acid
  MOD_RES (1055)..(1058): Any amino acid
  MOD_RES (1060)..(1060): Any amino acid
  MOD_RES (1063)..(1065): Any amino acid
  MOD_RES (1068)..(1068): Any amino acid
  MOD_RES (1071)..(1071): Any amino acid
  MOD_RES (1075)..(1075): Any amino acid
  VARIANT (1078)..(1078): /replace="Ile"
  MOD_RES (1081)..(1081): Any amino acid
  MOD_RES (1088)..(1088): Any amino acid
  MOD_RES (1090)..(1090): Any amino acid
  MOD_RES (1111)..(1111): Any amino acid
  VARIANT (1113)..(1113): /replace="Ile"
  MOD_RES (1136)..(1137): Any amino acid
  MOD_RES (1140)..(1140): Any amino acid
  MOD_RES (1149)..(1149): Any amino acid
  MOD_RES (1154)..(1154): Any amino acid
  MOD_RES (1157)..(1158): Any amino acid
  MOD_RES (1162)..(1162): Any amino acid
  MOD_RES (1167)..(1169): Any amino acid
  MOD_RES (1171)..(1173): Any amino acid
  MOD_RES (1175)..(1175): Any amino acid
  MOD_RES (1187)..(1187): Any amino acid
  MOD_RES (1194)..(1194): Any amino acid
  MOD_RES (1208)..(1208): Any amino acid
  MOD_RES (1210)..(1213): Any amino acid
  MOD_RES (1225)..(1225): Any amino acid
  MOD_RES (1228)..(1228): Any amino acid
  MOD_RES (1234)..(1237): Any amino acid
  MOD_RES (1240)..(1242): Any amino acid
  MOD_RES (1244)..(1244): Any amino acid
  MOD_RES (1264)..(1264): Any amino acid
  MOD_RES (1268)..(1268): Any amino acid
  MOD_RES (1282)..(1282): Any amino acid
  MOD_RES (1284)..(1284): Any amino acid
  MOD_RES (1292)..(1293): Any amino acid
  MOD_RES (1302)..(1302): Any amino acid
  MOD_RES (1309)..(1309): Any amino acid
  MOD_RES (1313)..(1313): Any amino acid
  MOD_RES (1320)..(1320): Any amino acid
  MOD_RES (1324)..(1324): Any amino acid
  MOD_RES (1326)..(1327): Any amino acid
  MOD_RES (1331)..(1331): Any amino acid
  MOD_RES (1334)..(1334): Any amino acid
  MOD_RES (1336)..(1336): Any amino acid
  MOD_RES (1341)..(1341): Any amino acid
  MOD_RES (1350)..(1350): Any amino acid
  MOD_RES (1360)..(1364): Any amino acid
  MOD_RES (1366)..(1366): Any amino acid
  MOD_RES (1369)..(1369): Any amino acid
  MOD_RES (1375)..(1376): Any amino acid
  MOD_RES (1393)..(1395): Any amino acid
  MOD_RES (1397)..(1397): Any amino acid
  MOD_RES (1400)..(1400): Any amino acid
  MOD_RES (1408)..(1408): Any amino acid
  MOD_RES (1410)..(1410): Any amino acid
  MOD_RES (1420)..(1420): Any amino acid
  MOD_RES (1440)..(1440): Any amino acid
  MOD_RES (1446)..(1446): Any amino acid
  MOD_RES (1452)..(1452): Any amino acid
  MOD_RES (1457)..(1457): Any amino acid
  MOD_RES (1459)..(1459): Any amino acid
  VARIANT (1461)..(1461): /replace="Ile"
  MOD_RES (1463)..(1463): Any amino acid
  MOD_RES (1465)..(1466): Any amino acid
  MOD_RES (1470)..(1470): Any amino acid
  MOD_RES (1472)..(1472): Any amino acid
  MOD_RES (1475)..(1475): Any amino acid
  MOD_RES (1484)..(1485): Any amino acid
  MOD_RES (1494)..(1494): Any amino acid
  MOD_RES (1496)..(1498): Any amino acid
  MOD_RES (1500)..(1501): Any amino acid
  MOD_RES (1504)..(1504): Any amino acid
  MOD_RES (1506)..(1506): Any amino acid
  MOD_RES (1508)..(1511): Any amino acid
  MOD_RES (1513)..(1514): Any amino acid
  MOD_RES (1518)..(1518): Any amino acid
  VARIANT (1522)..(1522): /replace="Ile"
  MOD_RES (1530)..(1530): Any amino acid
  MOD_RES (1532)..(1532): Any amino acid
  MOD_RES (1535)..(1537): Any amino acid
  MOD_RES (1539)..(1540): Any amino acid
  MOD_RES (1542)..(1542): Any amino acid
  MOD_RES (1548)..(1548): Any amino acid
  MOD_RES (1559)..(1559): Any amino acid
  MOD_RES (1565)..(1565): Any amino acid
  MOD_RES (1568)..(1568): Any amino acid
  MOD_RES (1580)..(1581): Any amino acid
  MOD_RES (1584)..(1585): Any amino acid
  MOD_RES (1588)..(1588): Any amino acid
  MOD_RES (1596)..(1596): Any amino acid
  MOD_RES (1602)..(1602): Any amino acid
  MOD_RES (1633)..(1635): Any amino acid
  MOD_RES (1640)..(1640): Any amino acid
  MOD_RES (1643)..(1646): Any amino acid
  MOD_RES (1653)..(1653): Any amino acid
  MOD_RES (1659)..(1659): Any amino acid
  MOD_RES (1668)..(1668): Any amino acid
  MOD_RES (1675)..(1676): Any amino acid
  MOD_RES (1683)..(1683): Any amino acid
  MOD_RES (1694)..(1696): Any amino acid
  MOD_RES (1705)..(1705): Any amino acid
  MOD_RES (1716)..(1718): Any amino acid
  MOD_RES (1720)..(1720): Any amino acid
  MOD_RES (1726)..(1726): Any amino acid
  MOD_RES (1733)..(1733): Any amino acid
  MOD_RES (1755)..(1756): Any amino acid
  MOD_RES (1758)..(1759): Any amino acid
  MOD_RES (1763)..(1763): Any amino acid
  MOD_RES (1767)..(1767): Any amino acid
MWISIKTLIHHLGVLFFCDMGNLFGHMKIXKVXHEKRXAKXKXPXKKVXVKRKYSGGGLLLNYNENPNKNKSXENILIKKKISFXXLKSSSKLBKTINKPDXKKXXXXLQWFLSEIVKKINRRNGLVLSDMLSVDKRXXEKIXEKXXXLKYFXXXXXXLXKLHQEKPSKKLFNLKDLKEXEEXVLFLKXKFKNELXYXXENDXXKDIEKILXEXLRXGFXPADKKLKXKFLIEXXWGIFSXXXKLEPYXIQEDFXEXYIEDFKKLNKXKXLXKSIENNKIVSQKSSDSQIYEXGKNIIMSXXGXIESIIEXXSKRKXXLDKYATXXLXEKLLLDEXLXIEQXXXNXXEXXDKLASNLKXYXLXKLYFYVKXDKKKSXXEVAKAAVSAAKDXNKDKYQNEVWXXHEXRKEDKRDFIXXXLEIXXIXKXIXKVKXXIXKXAXXEAXEXIKXXNIGKYRXXLDLFELEEDNXLNQFXXFVNIEXXKFFXHYXPNXIKRIXXXKNDAXAXXLKXGELXKKVEKQLKNGALSIYXIXXGKAVYYXXFAMKXLADSDYWTXKDLEXIKISEAFLRKFIGACSFAYXSLXAXNILQPECXXDILGKGDLLXKATVNIXQXXSEHIMYLGKLRHNDIDXLLXFKEDIAKSTXKXGXGXLXKNLIQFFGGESTWDNKIFXAAYXXXLXGXXENEDFLGWALRGAIXSIRNEXFHSFKIKKHXXXXFLNIXNFIXXKLXEFEKXXXXKXKEXXHXXXTSYXXXLIKKLFXNEXXKXXLPXXIKELKLKSSGVXMYYSXDDLKKLLENIYFKFSLLKIXEENXEXAXFVPSFKKVYXRADGVKGFDYQXXXTRXHAYXLKLXPFFDXEEXEXEAFNARYYLLKXIYYNXILEXXXEENEXXXXFLPKFXXXNNXAFREXXNFXADXIEXYYKRLQINKKKGAXKXXKKKXQXKVXNXYNRKXFAYAFENIRXMXFXETPREYMQYIQSEYXIENNGKEXKKSXXENKRNKDXFXHXEKFLLQVFIKGFDXYLDXRXENFXFILXPEPQNGTKEYLYEEXXAILDEXXXXNXLRXXXITXNKXLKLXEFLPEXKSDIKVXPXLVEEIYDYIKKIKINKIKKDXELAFWQDAALYLFCEKLLDARHLSXXLRXELIKYKQFXKDIKXRAXXNGNXINHSXXXNXXXVXECTDELEIIELXLLLNDRXSNDFKDYFDDEEAXIXXXXLCRIIFYAEYLXKYXKEEDDXXXXAEXXXFXALEPFCQSDTAREAKNDIYXDGGXNPELRVPILNRGIXQXKKIYGTEXXLEKLFDKNXLFBIDGXBIPXFKVSEEXAIIXEXXEKKXEIXEXSQYKXRGELHTEWXQKAREIEEYXXXXXKXKFXKKPQNXXFEKRFIEKHGQEYKKAXXXIXEYXWLKNKVEXNXLNELHELLIXLLGRLIGYSALFERDLQYFXNGFHYXCLNNDXEKLAXYXNLSXVXXKNRXIXKAXLYQIFAMYXXGLPFYSKDXDXXXAXXSGXKXSXXXXSXXTAGXGKKLKKFKKYSXYXLIXXXLXXDXSKKLDXYLAGLELFENXEEHDNXTEXIRNYIAHFNYLXXAGXXADXSLLELYNXLRDRLXSYDRKLKNAVSKSLIDILDRHGMILKFKFKXXXKLIGXNDXXXXAIKHKDXARITIXEPNGVTSEXFTYKLLXXVAALEIXSLEPKKIRHLXXXARLLYYPKXATAQSQPDQKXXXKXKKKNIXKGYIERXTNQVSSNQEEYCELVKKLLETXXLXXLAVXGVAXBIGLHISRLRRIREDAIIVGRRYRFRVEIYVPPKSNTSKLNAADLVRID

SEQ ID NO: 181 - DNA, 24 bp, Artificial Sequence
  Synthetic
ttgccatgacccttgccgttgttg

SEQ ID NO: 182 - DNA, 24 bp, Artificial Sequence
  Synthetic
tgatgatgcagtagtcaggacctt

SEQ ID NO: 183 - DNA, 24 bp, Artificial Sequence
  Synthetic
caagtttgtgtacccgaggatttg

SEQ ID NO: 184 - DNA, 24 bp, Artificial Sequence
  Synthetic
agctagtcccaataaatatgcgct

SEQ ID NO: 185 - DNA, 20 bp, Artificial Sequence
  Synthetic
ctgtagtcgttggctgtggt

SEQ ID NO: 186 - DNA, 20 bp, Artificial Sequence
  Synthetic
cagcgttccccaagaagagt

SEQ ID NO: 187 - DNA, 28 bp, Artificial Sequence
  Synthetic
agattgctgttctaccaagtaatccata

SEQ ID NO: 188 - DNA, 28 bp, Artificial Sequence
  Synthetic
tatggattacttggtagaacagcaatct

SEQ ID NO: 189 - DNA, 28 bp, Artificial Sequence
  Synthetic
atcagggcaaacagaactttgactccca

SEQ ID NO: 190 - DNA, 28 bp, Artificial Sequence
  Synthetic
gtgcagccagctttccgggcattggctt

SEQ ID NO: 191 - DNA, 28 bp, Artificial Sequence
  Synthetic
tagattgctgttctaccaagtaatccat

SEQ ID NO: 192 - DNA, 28 bp, Artificial Sequence
  Synthetic
tccttgattacacgatggaatttgctgt

SEQ ID NO: 193 - DNA, 28 bp, Artificial Sequence
  Synthetic
atgataatgcaatagcaggacaggatga

SEQ ID NO: 194 - DNA, 28 bp, Artificial Sequence
  Synthetic
aatttctcgaactaatgtatagaaggca

SEQ ID NO: 195 - DNA, 28 bp, Artificial Sequence
  Synthetic
ccaccaccaccgcctcccgccgcccccg

SEQ ID NO: 196 - DNA, 28 bp, Artificial Sequence
  Synthetic
tgctcccatcatctcaagtacctcagca

SEQ ID NO: 197 - DNA, 28 bp, Artificial Sequence
  Synthetic
cccttgacacgaacaggtgggcattcag

SEQ ID NO: 198 - DNA, 28 bp, Artificial Sequence
  Synthetic
agaaggtcacctgtacggcgagcacggc

SEQ ID NO: 199 - DNA, 28 bp, Artificial Sequence
  Synthetic
cagatccgcttgagggtggcgatctggt

SEQ ID NO: 200 - DNA, 28 bp, Artificial Sequence
  Synthetic
ccggacgatcgggcatccccgccatctc

SEQ ID NO: 201 - DNA, 28 bp, Artificial Sequence
  Synthetic
gactgagcacaaagcttcccagatagaa

SEQ ID NO: 202 - DNA, 28 bp, Artificial Sequence
  Synthetic
accatccaagaatgccatcttagaacca

SEQ ID NO: 203 - DNA, 28 bp, Artificial Sequence
  Synthetic
cctggcaaacaacctgtagagcaccgag

SEQ ID NO: 204 - DNA, 28 bp, Artificial Sequence
  Synthetic
tagattgctgtttcacacagatatgcat

SEQ ID NO: 205 - DNA, 28 bp, Artificial Sequence
  Synthetic
tataatggtgaatatcttcaaatgattt

SEQ ID NO: 206 - DNA, 28 bp, Artificial Sequence
  Synthetic
atgtatagaaggcatcatcaacaccctg

SEQ ID NO: 207 - DNA, 28 bp, Artificial Sequence
  Synthetic
ggttaaaaatttacagattgtgctgagc

SEQ ID NO: 208 - DNA, 28 bp, Artificial Sequence
  Synthetic
gtagatgctctttcctcctgtgccatct

SEQ ID NO: 209 - DNA, 28 bp, Artificial Sequence
  Synthetic
cagtttgaagttctcatcggggaagcgc

SEQ ID NO: 210 - DNA, 28 bp, Artificial Sequence
  Synthetic
cagtgttggtaggagtttgttacaaaag

SEQ ID NO: 211 - DNA, 28 bp, Artificial Sequence
  Synthetic
cttggccaagtctgttatgttcacctga

SEQ ID NO: 212 - DNA, 28 bp, Artificial Sequence
  Synthetic
caaaatgtactcagcttcaatcacaaat

SEQ ID NO: 213 - DNA, 28 bp, Artificial Sequence
  Synthetic
ggttatagcttgacaagcaattaacttt

SEQ ID NO: 214 - DNA, 28 bp, Artificial Sequence
  Synthetic
tccttgattacacgatggaatttgctgt

SEQ ID NO: 215 - DNA, 28 bp, Artificial Sequence
  Synthetic
atgataatgcaatagcaggacaggatga

SEQ ID NO: 216 - DNA, 28 bp, Artificial Sequence
  Synthetic
aatttctcgaactaatgtatagaaggca

SEQ ID NO: 217 - DNA, 28 bp, Artificial Sequence
  Synthetic
gcgtgagccaccgcgcctggccggctgt

SEQ ID NO: 218 - DNA, 28 bp, Artificial Sequence
  Synthetic
ccagctgcagatgctgcagtttttggcg

SEQ ID NO: 219 - DNA, 28 bp, Artificial Sequence
  Synthetic
atcagggcaaacagaactttgactccca

SEQ ID NO: 220 - DNA, 28 bp, Artificial Sequence
  Synthetic
ttcagggcaaacagaactttgactccca

SEQ ID NO: 221 - DNA, 28 bp, Artificial Sequence
  Synthetic
atctgggcaaacagaactttgactccca

SEQ ID NO: 222 - DNA, 28 bp, Artificial Sequence
  Synthetic
atcaggccaaacagaactttgactccca

SEQ ID NO: 223 - DNA, 28 bp, Artificial Sequence
  Synthetic
atcagggcatacagaactttgactccca

SEQ ID NO: 224 - DNA, 28 bp, Artificial Sequence
  Synthetic
atcagggcaaactgaactttgactccca

SEQ ID NO: 225 - DNA, 28 bp, Artificial Sequence
  Synthetic
atcagggcaaacagatctttgactccca

SEQ ID NO: 226 - DNA, 28 bp, Artificial Sequence
  Synthetic
atcagggcaaacagaactatgactccca

SEQ ID NO: 227 - DNA, 28 bp, Artificial Sequence
  Synthetic
atcagggcaaacagaactttgtctccca

SEQ ID NO: 228 - DNA, 28 bp, Artificial Sequence
  Synthetic
atcagggcaaacagaactttgactgcca

SEQ ID NO: 229 - DNA, 28 bp, Artificial Sequence
  Synthetic
atcagggcaaacagaactttgactccct

SEQ ID NO: 230 - DNA, 28 bp, Artificial Sequence
  Synthetic
atgataatgcaatagcaggacaggatga

SEQ ID NO: 231 - DNA, 28 bp, Artificial Sequence
  Synthetic
ttgataatgcaatagcaggacaggatga

SEQ ID NO: 232 - DNA, 28 bp, Artificial Sequence
  Synthetic
atgttaatgcaatagcaggacaggatga

SEQ ID NO: 233 - DNA, 28 bp, Artificial Sequence
  Synthetic
atgatattgcaatagcaggacaggatga

SEQ ID NO: 234 - DNA, 28 bp, Artificial Sequence
  Synthetic
atgataatggaatagcaggacaggatga

SEQ ID NO: 235 - DNA, 28 bp, Artificial Sequence
  Synthetic
atgataatgcaaaagcaggacaggatga

SEQ ID NO: 236 - DNA, 28 bp, Artificial Sequence
  Synthetic
atgataatgcaataggaggacaggatga

SEQ ID NO: 237 - DNA, 28 bp, Artificial Sequence
  Synthetic
atgataatgcaatagcagcacaggatga

SEQ ID NO: 238 - DNA, 28 bp, Artificial Sequence
  Synthetic
atgataatgcaatagcaggactggatga

SEQ ID NO: 239 - DNA, 28 bp, Artificial Sequence
  Synthetic
atgataatgcaatagcaggacaggttga

SEQ ID NO: 240 - DNA, 28 bp, Artificial Sequence
  Synthetic
atgataatgcaatagcaggacaggatgt

SEQ ID NO: 241 - DNA, 28 bp, Artificial Sequence
  Synthetic
gtgcagccagctttccgggcattggctt

SEQ ID NO: 242 - DNA, 28 bp, Artificial Sequence
  Synthetic
ctgcagccagctttccgggcattggctt

SEQ ID NO: 243 - DNA, 28 bp, Artificial Sequence
  Synthetic
gtggagccagctttccgggcattggctt

SEQ ID NO: 244 - DNA, 28 bp, Artificial Sequence
  Synthetic
gtgcaggcagctttccgggcattggctt

SEQ ID NO: 245 - DNA, 28 bp, Artificial Sequence
  Synthetic
gtgcagccacctttccgggcattggctt

SEQ ID NO: 246 - DNA, 28 bp, Artificial Sequence
  Synthetic
gtgcagccagctatccgggcattggctt

SEQ ID NO: 247 - DNA, 28 bp, Artificial Sequence
  Synthetic
gtgcagccagctttcggggcattggctt

SEQ ID NO: 248 - DNA, 28 bp, Artificial Sequence
  Synthetic
gtgcagccagctttccggccattggctt

SEQ ID NO: 249 - DNA, 28 bp, Artificial Sequence
  Synthetic
gtgcagccagctttccgggcaatggctt

SEQ ID NO: 250 - DNA, 28 bp, Artificial Sequence
  Synthetic
gtgcagccagctttccgggcattgcctt

SEQ ID NO: 251 - DNA, 28 bp, Artificial Sequence
  Synthetic
gtgcagccagctttccgggcattggcta

SEQ ID NO: 252 - DNA, 28 bp, Artificial Sequence
  Synthetic
tataatggtgaatatcttcaaatgattt

SEQ ID NO: 253 - DNA, 28 bp, Artificial Sequence
  Synthetic
aataatggtgaatatcttcaaatgattt

SEQ ID NO: 254 - DNA, 28 bp, Artificial Sequence
  Synthetic
tattatggtgaatatcttcaaatgattt

SEQ ID NO: 255 - DNA, 28 bp, Artificial Sequence
  Synthetic
tataatcgtgaatatcttcaaatgattt

SEQ ID NO: 256 - DNA, 28 bp, Artificial Sequence
  Synthetic
tataatggtcaatatcttcaaatgattt

SEQ ID NO: 257 - DNA, 28 bp, Artificial Sequence
  Synthetic
tataatggtgaaaatcttcaaatgattt

SEQ ID NO: 258 - DNA, 28 bp, Artificial Sequence
  Synthetic
tataatggtgaatatgttcaaatgattt

SEQ ID NO: 259 - DNA, 28 bp, Artificial Sequence
  Synthetic
tataatggtgaatatcttgaaatgattt

SEQ ID NO: 260 - DNA, 28 bp, Artificial Sequence
  Synthetic
tataatggtgaatatcttcaattgattt

SEQ ID NO: 261 - DNA, 28 bp, Artificial Sequence
  Synthetic
tataatggtgaatatcttcaaatgtttt

SEQ ID NO: 262 - DNA, 28 bp, Artificial Sequence
  Synthetic
tataatggtgaatatcttcaaatgatta

SEQ ID NO: 263 - DNA, 28 bp, Artificial Sequence
  Synthetic
gtagatgctctttcctcctgtgccatct

SEQ ID NO: 264 - DNA, 28 bp, Artificial Sequence
  Synthetic
ctagatgctctttcctcctgtgccatct

SEQ ID NO: 265 - DNA, 28 bp, Artificial Sequence
  Synthetic
gtacatgctctttcctcctgtgccatct

SEQ ID NO: 266 - DNA, 28 bp, Artificial Sequence
  Synthetic
gtagatcctctttcctcctgtgccatct

SEQ ID NO: 267 - DNA, 28 bp, Artificial Sequence
  Synthetic
gtagatgctgtttcctcctgtgccatct

SEQ ID NO: 268 - DNA, 28 bp, Artificial Sequence
  Synthetic
gtagatgctcttacctcctgtgccatct

SEQ ID NO: 269 - DNA, 28 bp, Artificial Sequence
  Synthetic
gtagatgctctttccacctgtgccatct

SEQ ID NO: 270 - DNA, 28 bp, Artificial Sequence
  Synthetic
gtagatgctctttcctccagtgccatct

SEQ ID NO: 271 - DNA, 28 bp, Artificial Sequence
  Synthetic
gtagatgctctttcctcctgtcccatct

SEQ ID NO: 272 - DNA, 28 bp, Artificial Sequence
  Synthetic
gtagatgctctttcctcctgtgccttct

SEQ ID NO: 273 - DNA, 28 bp, Artificial Sequence
  Synthetic
gtagatgctctttcctcctgtgccatca

SEQ ID NO: 274 - DNA, 28 bp, Artificial Sequence
  Synthetic
gtgcagccagctttccgggcattggctt

SEQ ID NO: 275 - DNA, 28 bp, Artificial Sequence
  Synthetic
cagcagccagctttccgggcattggctt

SEQ ID NO: 276 - DNA, 28 bp, Artificial Sequence
  Synthetic
gtggtgccagctttccgggcattggctt

SEQ ID NO: 277 - DNA, 28 bp, Artificial Sequence
  Synthetic
gtgcagggagctttccgggcattggctt

SEQ ID NO: 278 - DNA, 28 bp, Artificial Sequence
  Synthetic
gtgcagccacgtttccgggcattggctt

SEQ ID NO: 279 - DNA, 28 bp, Artificial Sequence
  Synthetic
gtgcagccagctaaccgggcattggctt

SEQ ID NO: 280 - DNA, 28 bp, Artificial Sequence
  Synthetic
gtgcagccagctttcgcggcattggctt

SEQ ID NO: 281 - DNA, 28 bp, Artificial Sequence
  Synthetic
gtgcagccagctttccggcgattggctt

SEQ ID NO: 282 - DNA, 28 bp, Artificial Sequence
  Synthetic
gtgcagccagctttccgggcaaaggctt

SEQ ID NO: 283 - DNA, 28 bp, Artificial Sequence
  Synthetic
gtgcagccagctttccgggcattgcgtt

SEQ ID NO: 284 - DNA, 28 bp, Artificial Sequence
  Synthetic
ctgctgccagctttccgggcattggctt

SEQ ID NO: 285 - DNA, 28 bp, Artificial Sequence
  Synthetic
ctgcagcctgctttccgggcattggctt

SEQ ID NO: 286 - DNA, 28 bp, Artificial Sequence
  Synthetic
ctgcagccagctatccgggcattggctt

SEQ ID NO: 287 - DNA, 28 bp, Artificial Sequence
  Synthetic
ctgcagccagctttcccggcattggctt

SEQ ID NO: 288 - DNA, 28 bp, Artificial Sequence
  Synthetic
gtggagcgagctttccgggcattggctt

SEQ ID NO: 289 - DNA, 28 bp, Artificial Sequence
  Synthetic
gtggagccagcattccgggcattggctt

SEQ ID NO: 290 - DNA, 28 bp, Artificial Sequence
  Synthetic
gtggagccagctttcggggcattggctt

SEQ ID NO: 291 - DNA, 28 bp, Artificial Sequence
  Synthetic
gtggagccagctttccggggattggctt

SEQ ID NO: 292 - DNA, 28 bp, Artificial Sequence
  Synthetic
gtgcaggcaggtttccgggcattggctt

SEQ ID NO: 293 - DNA, 28 bp, Artificial Sequence
  Synthetic
gtgcaggcagctttgcgggcattggctt

SEQ ID NO: 294 - DNA, 28 bp, Artificial Sequence
  Synthetic
gtgcaggcagctttccggccattggctt

SEQ ID NO: 295 - DNA, 28 bp, Artificial Sequence
  Synthetic
gtgcaggcagctttccgggcataggctt

SEQ ID NO: 296 - DNA, 28 bp, Artificial Sequence
  Synthetic
gtgcagccaccttaccgggcattggctt

SEQ ID NO: 297 - DNA, 28 bp, Artificial Sequence
  Synthetic
gtgcagccacctttccgcgcattggctt

SEQ ID NO: 298 - DNA, 28 bp, Artificial Sequence
  Synthetic
gtgcagccacctttccgggcaatggctt

SEQ ID NO: 299 - DNA, 28 bp, Artificial Sequence
  Synthetic
gtgcagccacctttccgggcattgggtt

SEQ ID NO: 300 - DNA, 28 bp, Artificial Sequence
  Synthetic
gtgcagccagctatcccggcattggctt

SEQ ID NO: 301 - DNA, 28 bp, Artificial Sequence
  Synthetic
gtgcagccagctatccgggctttggctt

SEQ ID NO: 302 - DNA, 28 bp, Artificial Sequence
  Synthetic
gtgcagccagctatccgggcattgcctt

SEQ ID NO: 303 - DNA, 28 bp, Artificial Sequence
  Synthetic
gtgcagccagctttcgggggattggctt

SEQ ID NO: 304 - DNA, 28 bp, Artificial Sequence
  Synthetic
gtgcagccagctttcggggcattcgctt

SEQ ID NO: 305 - DNA, 28 bp, Artificial Sequence
  Synthetic
gtgcagccagctttcggggcattggcta

SEQ ID NO: 306 - DNA, 28 bp, Artificial Sequence
  Synthetic
gtgcagccagctttccggccataggctt

SEQ ID NO: 307 - DNA, 28 bp, Artificial Sequence
  Synthetic
gtgcagccagctttccggccattggcat

SEQ ID NO: 308 - DNA, 28 bp, Artificial Sequence
  Synthetic
atcagggcaaacagaactttgactccca

SEQ ID NO: 309 - DNA, 28 bp, Artificial Sequence
  Synthetic
gctgtaataattaggtaacatttatttc

SEQ ID NO: 310 - DNA, 28 bp, Artificial Sequence
  Synthetic
gtcagtgttggtaggagtttgttacaaa

SEQ ID NO: 311 - DNA, 28 bp, Artificial Sequence
  Synthetic
gtgcagccagctttccgggcattggctt

SEQ ID NO: 312 - DNA, 28 bp, Artificial Sequence
  Synthetic
ctggcggcgggtgtggacgggcggcgga

SEQ ID NO: 313 - DNA, 28 bp, Artificial Sequence
  Synthetic
gagccacacgcagctcattgtagaaggt

SEQ ID NO: 314 - RNA, 48 nt, Artificial Sequence
  Synthetic
aaaguucuguuugcccugauccucgaggaucagggcaaacagaacuuu

SEQ ID NO: 315 - RNA, 48 nt, Artificial Sequence
  Synthetic
aagccaaugcccggaaagcugcucgagcagcuuuccgggcauuggcuu

SEQ ID NO: 316 - RNA, 48 nt, Artificial Sequence
  Synthetic
uagauugcuguucuaccaagucucgagacuugguagaacagcaaucua

SEQ ID NO: 317 - RNA, 48 nt, Artificial Sequence
  Synthetic
acagcaaauuccaucguguaacucgaguuacacgauggaauuugcugu

SEQ ID NO: 318 - RNA, 48 nt, Artificial Sequence
  Synthetic
auccuguccugcuauugcauucucgagaaugcaauagcaggacaggau

SEQ ID NO: 319 - RNA, 48 nt, Artificial Sequence
  Synthetic
ccuucuauacauuaguucgagcucgagcucgaacuaauguauagaagg

SEQ ID NO: 320 - RNA, 48 nt, Artificial Sequence; identical to SEQ ID NO: 315
  Synthetic

SEQ ID NO: 321 - RNA, 48 nt, Artificial Sequence
  Synthetic
agauuccuggguucaaggacucucgagaguccuugaacccaggaaucu

SEQ ID NO: 322 - RNA, 48 nt, Artificial Sequence; identical to SEQ ID NO: 314
  Synthetic

SEQ ID NO: 323 - RNA, 48 nt, Artificial Sequence
  Synthetic
aaguggcuggagacaucauugcucgagcaaugaugucuccagccacuu

SEQ ID NO: 324 - RNA, 48 nt, Artificial Sequence
  Synthetic
aagccguguccgucccguacacucgaguguacgggacggacacggcuu

SEQ ID NO: 325 - RNA, 48 nt, Artificial Sequence
  Synthetic
aagaccuuaauucuugccguucucgagaacggcaagaauuaaggucuu

SEQ ID NO: 326 - RNA, 48 nt, Artificial Sequence
  Synthetic
aaucauuugaagauauucacccucgagggugaauaucuucaaaugauu

SEQ ID NO: 327 - RNA, 48 nt, Artificial Sequence
  Synthetic
aggguguugaugaugccuucucucgagagaaggcaucaucaacacccu

SEQ ID NO: 328 - RNA, 48 nt, Artificial Sequence
  Synthetic
aaucuguaaauuuuuaaccuacucgaguagguuaaaaauuuacagauu

SEQ ID NO: 329 - RNA, 48 nt, Artificial Sequence
  Synthetic
agauggcacaggaggaaagagcucgagcucuuuccuccugugccaucu

SEQ ID NO: 330 - RNA, 48 nt, Artificial Sequence
  Synthetic
agcgcuuccccgaugagaacucucgagaguucucaucggggaagcgcu

SEQ ID NO: 331 - RNA, 48 nt, Artificial Sequence
  Synthetic
aacauaacagacuuggccaagcucgagcuuggccaagucuguuauguu

SEQ ID NO: 332 - RNA, 48 nt, Artificial Sequence
  Synthetic
aagcugaguacauuuugcuggcucgagccagcaaaauguacucagcuu

SEQ ID NO: 333 - RNA, 48 nt, Artificial Sequence
  Synthetic
aaguuaauugcuugucaagcucucgagagcuugacaagcaauuaacuu

SEQ ID NO: 334 - RNA, 48 nt, Artificial Sequence; identical to SEQ ID NO: 314
  Synthetic

SEQ ID NO: 335 - RNA, 48 nt, Artificial Sequence
  Synthetic
uguuaccuaauuauuacagcccucgagggcuguaauaauuagguaaca

SEQ ID NO: 336 - RNA, 48 nt, Artificial Sequence
  Synthetic
aacuccuaccaacacugaccacucgaguggucaguguugguaggaguu

SEQ ID NO: 337 - RNA, 48 nt, Artificial Sequence
  Synthetic
aacuucgcgaccacggaucuccucgaggagauccguggucgcgaaguu

SEQ ID NO: 338 - RNA, 176 nt, Artificial Sequence
  Synthetic
gggggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacacaacauacgagccggaagcauaaag

SEQ ID NO: 339 - RNA, 176 nt, Artificial Sequence
  Synthetic
ggguagguguuccacaggguagccagcagcauccugcgaugcaaauauggauuacuugguagaacagcaaucuaauccggaacauaauggugcagggcgcugacuuccgcguuuccagacuuuacgaaacacggaaaccgaagaccauucauguuguugcugccggaagcauaaag

SEQ ID NO: 340 - RNA, 176 nt, Artificial Sequence
  Synthetic
gggccccuccguucgcguuuacgcggacggugagacugaagauaauauggauuacuugguagaacagcaaucuaaacucauucucuuuaaaauaucguucgaacuggacucccggucguuuuaacucgacuggggccaaaacgaaacaguggcacuaccccgccggaagcauaaag

SEQ ID NO: 341 - RNA, 174 nt, Artificial Sequence
  Synthetic
ggguagguguuccacaggguagccagcagcauccugcgaugcaaauauggauuacuugguagaacagcaaucuaauccggaacauaauggugcagggcgcugacuuccgcguuuguuuuaaaucaaacacggaaaccgaagaccauucauguuguugcugccggaagcauaaag

SEQ ID NO: 342 - RNA, 174 nt, Artificial Sequence
  Synthetic
ggguagguguuccacaggguagccagcagcauccugcgaugcaaauauggauuacuugguagaacagcaaucuaauccggaacauaauggugcagggcgcugacuuccgcguuugccccaaaccaaacacggaaaccgaagaccauucauguuguugcugccggaagcauaaag

SEQ ID NO: 343 - RNA, 174 nt, Artificial Sequence
  Synthetic
ggguagguguuccacaggguagccagcagcauccugcgaugcaaauauggauuacuugguagaacagcaaucuaauccggaacauaauggugcagggcgcugacuuccgcguuugggggaaagcaaacacggaaaccgaagaccauucauguuguugcugccggaagcauaaag

SEQ ID NO: 344 - RNA, 174 nt, Artificial Sequence
  Synthetic
ggguagguguuccacaggguagccagcagcauccugcgaugcaaauauggauuacuugguagaacagcaaucuaauccggaacauaauggugcagggcgcugacuuccgcguuugaaaaaaaacaaacacggaaaccgaagaccauucauguuguugcugccggaagcauaaag

SEQ ID NO: 345 - RNA, 178 nt, Artificial Sequence
  Synthetic
ggggauuuagacuaccccaaaaacgaaggggacuaaaacuuucuuuucuucgauguggauugguuuaccaggauuuagacuaccccaaaaacgaaggggacuaaaacguaaaauagauacaauaacuucuucuacaugauuuagacuaccccaaaaacgaaggggacuaaaacgcgcg

SEQ ID NO: 346 - DNA, 67 bp, Artificial Sequence
  Synthetic
ggggatttagactaccccaaaaacgaaggggactaaaactagattgctgttctaccaagtaatccat

SEQ ID NO: 347 - DNA, 68 bp, Artificial Sequence
  Synthetic
ggggatttagactaccccaaaaacgaaggggactaaaactagattgctgttctaccaagtaatccata

SEQ ID NO: 348 - DNA, 66 bp, Artificial Sequence
  Synthetic
ggggatttagactaccccaaaaacgaaggggactaaaactagattgctgttctaccaagtaatcca

SEQ ID NO: 349 - DNA, 65 bp, Artificial Sequence
  Synthetic
ggggatttagactaccccaaaaacgaaggggactaaaactagattgctgttctaccaagtaatcc

SEQ ID NO: 350 - DNA, 64 bp, Artificial Sequence
  Synthetic
ggggatttagactaccccaaaaacgaaggggactaaaactagattgctgttctaccaagtaatc

SEQ ID NO: 351 - DNA, 63 bp, Artificial Sequence
  Synthetic
ggggatttagactaccccaaaaacgaaggggactaaaactagattgctgttctaccaagtaat

SEQ ID NO: 352 - DNA, 62 bp, Artificial Sequence
  Synthetic
ggggatttagactaccccaaaaacgaaggggactaaaactagattgctgttctaccaagtaa

SEQ ID NO: 353 - DNA, 61 bp, Artificial Sequence
  Synthetic
ggggatttagactaccccaaaaacgaaggggactaaaactagattgctgttctaccaagta

SEQ ID NO: 354 - DNA, 60 bp, Artificial Sequence
  Synthetic
ggggatttagactaccccaaaaacgaaggggactaaaactagattgctgttctaccaagt

SEQ ID NO: 355 - DNA, 59 bp, Artificial Sequence
  Synthetic
ggggatttagactaccccaaaaacgaaggggactaaaactagattgctgttctaccaag

SEQ ID NO: 356 - DNA, 58 bp, Artificial Sequence
  Synthetic
ggggatttagactaccccaaaaacgaaggggactaaaactagattgctgttctaccaa

SEQ ID NO: 357 - DNA, 57 bp, Artificial Sequence
  Synthetic
ggggatttagactaccccaaaaacgaaggggactaaaactagattgctgttctacca

SEQ ID NO: 358 - DNA, 56 bp, Artificial Sequence
  Synthetic
ggggatttagactaccccaaaaacgaaggggactaaaactagattgctgttctacc

SEQ ID NO: 359 - DNA, 55 bp, Artificial Sequence
  Synthetic
ggggatttagactaccccaaaaacgaaggggactaaaactagattgctgttctac

SEQ ID NO: 360 - DNA, 54 bp, Artificial Sequence
  Synthetic
ggggatttagactaccccaaaaacgaaggggactaaaactagattgctgttcta

SEQ ID NO: 361 - DNA, 53 bp, Artificial Sequence
  Synthetic
ggggatttagactaccccaaaaacgaaggggactaaaactagattgctgttct

SEQ ID NO: 362 - DNA, 52 bp, Artificial Sequence
  Synthetic
ggggatttagactaccccaaaaacgaaggggactaaaactagattgctgttc

SEQ ID NO: 363 - DNA, 51 bp, Artificial Sequence
  Synthetic
ggggatttagactaccccaaaaacgaaggggactaaaactagattgctgtt

SEQ ID NO: 364 - DNA, 50 bp, Artificial Sequence
  Synthetic
ggggatttagactaccccaaaaacgaaggggactaaaactagattgctgt

SEQ ID NO: 365 - DNA, 49 bp, Artificial Sequence
  Synthetic
ggggatttagactaccccaaaaacgaaggggactaaaactagattgctg

SEQ ID NO: 366 - RNA, 67 nt, Artificial Sequence
  Synthetic
ggggauuuagacuaccccaaaaacgaaggggacuaaaacuagauugcuguucuaccaaguaauccau

SEQ ID NO: 367 - RNA, 66 nt, Artificial Sequence
  Synthetic
ggggauuuagacuaccccaaaaacgaaggggacuaaaacuagauugcuguucuaccaaguaaucca

SEQ ID NO: 368 - RNA, 65 nt, Artificial Sequence
  Synthetic
ggggauuuagacuaccccaaaaacgaaggggacuaaaacuagauugcuguucuaccaaguaaucc

SEQ ID NO: 369 - RNA, 64 nt, Artificial Sequence
  Synthetic
ggggauuuagacuaccccaaaaacgaaggggacuaaaacuagauugcuguucuaccaaguaauc

SEQ ID NO: 370 - RNA, 63 nt, Artificial Sequence
  Synthetic
ggggauuuagacuaccccaaaaacgaaggggacuaaaacuagauugcuguucuaccaaguaau

SEQ ID NO: 371 - RNA, 62 nt, Artificial Sequence
  Synthetic
ggggauuuagacuaccccaaaaacgaaggggacuaaaacuagauugcuguucuaccaaguaa

SEQ ID NO: 372 - RNA, 61 nt, Artificial Sequence
  Synthetic
ggggauuuagacuaccccaaaaacgaaggggacuaaaacuagauugcuguucuaccaagua

SEQ ID NO: 373 - RNA, 60 nt, Artificial Sequence
  Synthetic
ggggauuuagacuaccccaaaaacgaaggggacuaaaacuagauugcuguucuaccaagu

SEQ ID NO: 374 - RNA, 59 nt, Artificial Sequence
  Synthetic
ggggauuuagacuaccccaaaaacgaaggggacuaaaacuagauugcuguucuaccaag

SEQ ID NO: 375 - RNA, 58 nt, Artificial Sequence
  Synthetic
ggggauuuagacuaccccaaaaacgaaggggacuaaaacuagauugcuguucuaccaa

SEQ ID NO: 376 - RNA, 57 nt, Artificial Sequence
  Synthetic
ggggauuuagacuaccccaaaaacgaaggggacuaaaacuagauugcuguucuacca

SEQ ID NO: 377 - RNA, 56 nt, Artificial Sequence
  Synthetic
ggggauuuagacuaccccaaaaacgaaggggacuaaaacuagauugcuguucuacc

SEQ ID NO: 378 - RNA, 55 nt, Artificial Sequence
  Synthetic
ggggauuuagacuaccccaaaaacgaaggggacuaaaacuagauugcuguucuac

SEQ ID NO: 379 - RNA, 54 nt, Artificial Sequence
  Synthetic
ggggauuuagacuaccccaaaaacgaaggggacuaaaacuagauugcuguucua

SEQ ID NO: 380 - RNA, 67 nt, Artificial Sequence
  Synthetic
ggggauuuagacuaccccaaaaacgaaggggacuaaaacaagauugcuguucuaccaaguaauccau

SEQ ID NO: 381 - RNA, 67 nt, Artificial Sequence
  Synthetic
ggggauuuagacuaccccaaaaacgaaggggacuaaaacuacauugcuguucuaccaaguaauccau

SEQ ID NO: 382 - RNA, 67 nt, Artificial Sequence
  Synthetic
ggggauuuagacuaccccaaaaacgaaggggacuaaaacuagaaugcuguucuaccaaguaauccau

SEQ ID NO: 383 - RNA, 67 nt, Artificial Sequence
  Synthetic
ggggauuuagacuaccccaaaaacgaaggggacuaaaacuagauuccuguucuaccaaguaauccau

SEQ ID NO: 384 - RNA, 67 nt, Artificial Sequence
  Synthetic
ggggauuuagacuaccccaaaaacgaaggggacuaaaacuagauugcaguucuaccaaguaauccau

SEQ ID NO: 385 - RNA, 67 nt, Artificial Sequence
  Synthetic
ggggauuuagacuaccccaaaaacgaaggggacuaaaacuagauugcugaucuaccaaguaauccau

SEQ ID NO: 386 - RNA, 67 nt, Artificial Sequence
  Synthetic
ggggauuuagacuaccccaaaaacgaaggggacuaaaacuagauugcuguuguaccaaguaauccau

SEQ ID NO: 387 - RNA, 67 nt, Artificial Sequence
  Synthetic
ggggauuuagacuaccccaaaaacgaaggggacuaaaacuagauugcuguucuuccaaguaauccau

SEQ ID NO: 388 - RNA, 67 nt, Artificial Sequence
  Synthetic
ggggauuuagacuaccccaaaaacgaaggggacuaaaacuagauugcuguucuacgaaguaauccau

SEQ ID NO: 389 - RNA, 67 nt, Artificial Sequence
  Synthetic
ggggauuuagacuaccccaaaaacgaaggggacuaaaacuagauugcuguucuaccauguaauccau

SEQ ID NO: 390 - RNA, 176 nt, Artificial Sequence; identical to SEQ ID NO: 338
  Synthetic

SEQ ID NO: 391 - RNA, 176 nt, Artificial Sequence
  Synthetic
gggggccagugaauucgagcucgguacccggggauccucuagaaauauggauuacuugguagaacagcaauguacucgaccugcaggcaugcaagcuuggcguaaucauggucauagcuguuuccuguguuuauccgcucacaauuccacacaacauacgagccggaagcauaaag

SEQ ID NO: 392 - DNA, 13 bp, Artificial Sequence
  Synthetic probe sequence
  MISC_FEATURE (1)..(1): /56-FAM/ is a 5' 6-Fam (Fluorescein) modification
  MISC_FEATURE (9)..(10): /ZEN/ is an internal quencher positioned between the 9th and 10th residues
  MISC_FEATURE (13)..(13): /3IABkFQ/ is a 3' Iowa black quencher
ccgagaacaacga

SEQ ID NO: 393 - DNA, 21 bp, Artificial Sequence
  Synthetic forward primer
aagttctgtttgccctgatct

SEQ ID NO: 394 - DNA, 19 bp, Artificial Sequence
  Synthetic reverse primer
ggccacgatgttgaagtct

SEQ ID NO: 395 - DNA, 28 bp, Leptotrichia shahii
ccaccccaatatcgaaggggactaaaac

SEQ ID NO: 396 - DNA, 36 bp, Leptotrichia wadei
gatttagactaccccaaaaacgaaggggactaaaac

SEQ ID NO: 397 - DNA, 36 bp, Listeria seeligeri
gtaagagactacctctatatgaaagaggactaaaac

SEQ ID NO: 398 - DNA, 35 bp, Lachnospiraceae bacterium
gtattgagaaaagccagatatagttggcaatagac

SEQ ID NO: 399 - DNA, 35 bp, Lachnospiraceae bacterium
gttgatgagaagagcccaagatagagggcaataac

SEQ ID NO: 400 - DNA, 35 bp, [Clostridium] aminophilum
gtctattgccctctatatcgggctgttctccaaac

SEQ ID NO: 401 - DNA, 36 bp, Carnobacterium gallinarum
attaaagactacctctaaatgtaagaggactataac

SEQ ID NO: 402 - DNA, 36 bp, Carnobacterium gallinarum
aatataaactacctctaaatgtaagaggactataac

SEQ ID NO: 403 - DNA, 36 bp, Paludibacter propionicigenes
cttgtggattatcccaaaattgaagggaactacaac

SEQ ID NO: 404 - DNA, 36 bp, Listeria weihenstephanensis
gatttagagtacctcaaaatagaagaggtctaaaac

SEQ ID NO: 405 - DNA, 36 bp, Listeria newyorkensis
gatttagagtacctcaaaacaaaagaggactaaaac

SEQ ID NO: 406 - DNA, 36 bp, Leptotrichia wadei F0279
gatatagataaccccaaaaacgaagggatctaaaac

SEQ ID NO: 407 - DNA, 36 bp, Rhodobacter capsulatus
gcctcacatcaccgccaagacgacggcggactgaac

SEQ ID NO: 408 - DNA, 36 bp, Rhodobacter capsulatus; identical to SEQ ID NO: 407

SEQ ID NO: 409 - DNA, 36 bp, Rhodobacter capsulatus; identical to SEQ ID NO: 407

SEQ ID NO: 410 - RNA, 36 nt, Artificial Sequence
  Synthetic
augggagucaaaguucuguuugcccugaucugcauc

SEQ ID NO: 411 - RNA, 36 nt, Artificial Sequence
  Synthetic
auggaagccaaugcccggaaagcuggcugcaccagg

SEQ ID NO: 412 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 413 - DNA, 40 bp, Leptotrichia wadei
tctgtttgccctgatctgcatcgctgtggccgaggccaag

SEQ ID NO: 414 - DNA, 28 bp, Artificial Sequence
  Synthetic
actagacgtagcgacaccggctccggtt

SEQ ID NO: 415 - DNA, 28 bp, Artificial Sequence
  Synthetic
gggactagacgtagcgacaccggctccg

SEQ ID NO: 416 - DNA, 28 bp, Artificial Sequence
  Synthetic
aacgggactagacgtagcgacaccggct

SEQ ID NO: 417 - DNA, 28 bp, Artificial Sequence
  Synthetic
caaacgggactagacgtagcgacaccgg

SEQ ID NO: 418 - DNA, 28 bp, Artificial Sequence
  Synthetic
agacaaacgggactagacgtagcgacac

SEQ ID NO: 419 - RNA, 70 nt, Leptotrichia wadei
uacccggggauccucuagaaauauggauuacuugguagaacagcaaucuacucgaccugcaggcaugcaa

SEQ ID NO: 420 - RNA, 56 nt, Artificial Sequence
  Synthetic
ccaccccaauaucgaaggggacuaaaacuagauugcuguucuaccaaguaauccau

SEQ ID NO: 421 - RNA, 65 nt, Artificial Sequence
  Synthetic
gauuuagacuaccccaaaaacgaaggggacuaaaacuagauugcuguucuaccaaguaauccaua

SEQ ID NO: 422 - RNA, 24 nt, Artificial Sequence
  Synthetic
uagauugcuguucuaccaaguaau

SEQ ID NO: 423 - RNA, 23 nt, Artificial Sequence
  Synthetic
uagauugcuguucuaccaaguaa

SEQ ID NO: 424 - RNA, 10 nt, Artificial Sequence
  Synthetic
uagauugcug

SEQ ID NO: 425 - protein, 1197 aa, Leptotrichia wadei
MKVTKIDGLSHKKFEDEGKLVKFRNNKNINEIKERLKKLKELKLDNYIKNPENVKNKDKDAEKETKIRRTNLKKYFSEIILRKEDEKYILKKTKKFKDINQEIDYYDVKSKKNQQEIFDVLKEILELKIKETEKEEIITFDSEKLKKVFGEDFVKKEAKIKAIEKSLKINKANYKKDSIKIGDDKYSNVKGENKRSRIYEYYKKSENLKKFEENIREAFEKLYTEENIKELYSKIEEILKKTHLKSIVREFYQNEIIGESEFSKKNGDGISILYNQIKDSIKKEENFIEFIENTGNLELKELTKSQIFYKYFLENEELNDENIKFAFCYFVEIEVNNLLKENVYKIKRFNESNKKRIENIFEYGKLKKLIVYKLENKLNNYVRNCGKYNYHMENGDIATSDINMRNRQTEAFLRSIIGVSSFGYFSLRNILGVNDDDFYETEEDLTKKERRNLEKAKEDITIKNTFDEVVVKSFQKKGIYNIKENLKMFYGDSFDNADKDELKQFFVNMLNAITSIRHRVVHYNMNTNSENIFNFSGIEVSKLLKSIFEKETDKRELKLKIFRQLNSAGVFDYWENRKIDKYLENIEFKFVNKNIPFVPSFTKLYNRIDNLKGNNALNLGYINIPKRKEARDSQIYLLKNIYYGEFVEKFVNNNDNFEKIFREIIEINKKDGTNTKTKFYKLEKFETLKANAPIEYLEKLQSLHQINYNREKVEEDKDIYVDFVQKIFLKGFINYLQGSDLLKSLNLLNLKKDEAIANKKSFYDEKLKLWQNNGSNLSKMPEEIYDYIKKIKINKINYSDRMSIFYLLLKLIDHKELTNLRGNLEKYVSMNKNKIYSEELNIVNLVSLDNNKVRANFNLKPEDIGKFLKTETSIRNINQLNNFSEIFADGENVIKHRSFYNIKKYGILDLLEKIVDKADLKITKEEIKKYENLQNELKRNDFYKIQERIHRNYNQKPFLIKNNEKDFNDYKKAIENIQNYTQLKNKIEFNDLNLLQSLLFRILHRLAGYTSLWERDLQFKLKGEYPENKYIDEIFNFDNSKNKIYNEKNERGGSVVSKYGYFLVEKDGEIQRKNARDKKKNKIIKKEGLEIRNYIAHFNYIPDATKSILEILEELRNLLKYDRKLKNAVMKSIKDIFKEYGLIIEFKISHVNNSEKIEVLNVDSEKIKHLKNNGLVTTRNSEDLCELIKMMLEYKKS

SEQ ID NO: 426 - DNA, 28 bp, Artificial Sequence
  Synthetic
gtgcagccagctttccgggcattggctt

SEQ ID NO: 427 - DNA, 28 bp, Artificial Sequence
  Synthetic
ctgctgccagctttccgggcattggctt

SEQ ID NO: 428 - DNA, 28 bp, Artificial Sequence
  Synthetic
ctgcagcctgctttccgggcattggctt

SEQ ID NO: 429 - DNA, 28 bp, Artificial Sequence
  Synthetic
ctgcagccagctatccgggcattggctt

SEQ ID NO: 430 - DNA, 28 bp, Artificial Sequence
  Synthetic
ctgcagccagctttcccggcattggctt

SEQ ID NO: 431 - DNA, 28 bp, Artificial Sequence
  Synthetic
gtggagcgagctttccgggcattggctt

SEQ ID NO: 432 - DNA, 28 bp, Artificial Sequence
  Synthetic
gtggagccagcattccgggcattggctt

SEQ ID NO: 433 - DNA, 28 bp, Artificial Sequence
  Synthetic
gtggagccagctttcggggcattggctt

SEQ ID NO: 434 - DNA, 28 bp, Artificial Sequence
  Synthetic
gtggagccagctttccggggattggctt

SEQ ID NO: 435 - DNA, 28 bp, Artificial Sequence
  Synthetic
gtgcaggcaggtttccgggcattggctt

SEQ ID NO: 436 - DNA, 28 bp, Artificial Sequence
  Synthetic
gtgcaggcagctttgcgggcattggctt

SEQ ID NO: 437 - DNA, 28 bp, Artificial Sequence
  Synthetic
gtgcaggcagctttccggccattggctt

SEQ ID NO: 438 - DNA, 28 bp, Artificial Sequence
  Synthetic
gtgcaggcagctttccgggcataggctt

SEQ ID NO: 439 - DNA, 28 bp, Artificial Sequence
  Synthetic
gtgcagccaccttaccgggcattggctt

SEQ ID NO: 440 - DNA, 28 bp, Artificial Sequence
  Synthetic
gtgcagccacctttccgcgcattggctt

SEQ ID NO: 441 - DNA, 28 bp, Artificial Sequence
  Synthetic
gtgcagccacctttccgggcaatggctt

SEQ ID NO: 442 - DNA, 28 bp, Artificial Sequence
  Synthetic
gtgcagccacctttccgggcattgggtt

SEQ ID NO: 443 - DNA, 28 bp, Artificial Sequence
  Synthetic
gtgcagccagctatcccggcattggctt

SEQ ID NO: 444 - DNA, 28 bp, Artificial Sequence
  Synthetic
gtgcagccagctatccgggctttggctt

SEQ ID NO: 445 - DNA, 28 bp, Artificial Sequence
  Synthetic
gtgcagccagctatccgggcattgcctt

SEQ ID NO: 446 - DNA, 28 bp, Artificial Sequence
  Synthetic
gtgcagccagctttcgggggattggctt

SEQ ID NO: 447 - DNA, 28 bp, Artificial Sequence
  Synthetic
gtgcagccagctttcggggcattcgctt

SEQ ID NO: 448 - DNA, 28 bp, Artificial Sequence
  Synthetic
gtgcagccagctttcggggcattggcta

SEQ ID NO: 449 - DNA, 28 bp, Artificial Sequence
  Synthetic
gtgcagccagctttccggccataggctt

SEQ ID NO: 450 - DNA, 28 bp, Artificial Sequence
  Synthetic
gtgcagccagctttccggccattggcat

SEQ ID NO: 451 - protein, 16 aa, Lactococcus lactis
LQKFTGDIENLVKASL

SEQ ID NO: 452 - protein, 15 aa, Lactococcus lactis
WIRAGWFIRNRSAHY

SEQ ID NO: 453 - protein, 16 aa, Lactococcus lactis
LQKFTGDIENLVKASL

SEQ ID NO: 454 - protein, 15 aa, Lactococcus lactis
WIRAGWFIRNRSAHY

SEQ ID NO: 455 - protein, 16 aa, Thermus aquaticus
PLEERGVAEAWLNAKV

SEQ ID NO: 456 - protein, 10 aa, Thermus aquaticus
ADLRNDVAHA

SEQ ID NO: 457 - protein, 16 aa, Thermus aquaticus
PLEERGVAEAWLNAKV

SEQ ID NO: 458 - protein, 10 aa, Thermus aquaticus
ADLRNDVAHA

SEQ ID NO: 459 - protein, 16 aa, Mycobacterium tuberculosis
RSATPAITIVLRAAVA

SEQ ID NO: 460 - protein, 15 aa, Mycobacterium tuberculosis
LGRFESRVRNTAAHE

SEQ ID NO: 461 - protein, 16 aa, Mycobacterium tuberculosis
RSATPAITIVLRAAVA

SEQ ID NO: 462 - protein, 15 aa, Mycobacterium tuberculosis
LGRFESRVRNTAAHE

SEQ ID NO: 463 - protein, 16 aa, Escherichia coli
LYPELRTIEGVLKSKM

SEQ ID NO: 464 - protein, 14 aa, Escherichia coli
AYTFFNVERHSLFH

SEQ ID NO: 465 - protein, 16 aa, Escherichia coli
LYPELRTIEGVLKSKM

SEQ ID NO: 466 - protein, 14 aa, Escherichia coli
AYTFFNVERHSLFH

SEQ ID NO: 467 - protein, 16 aa, Homo sapiens
GNELPLAVASTADLIR

SEQ ID NO: 468 - protein, 15 aa, Homo sapiens
IPDWIVDLRHELTHK

SEQ ID NO: 469 - protein, 16 aa, Homo sapiens
GNELPLAVASTADLIR

SEQ ID NO: 470 - protein, 15 aa, Homo sapiens
IPDWIVDLRHELTHK

SEQ ID NO: 471 - protein, 16 aa, Thermus thermophilus
IQRFEYTFEAFWKALQ

SEQ ID NO: 472 - protein, 15 aa, Thermus thermophilus
  MOD_RES (5)..(5): Any amino acid
LALGXVDDRSLTVHT

SEQ ID NO: 473 - protein, 16 aa, Thermus thermophilus
IQRFEYTFEAFWKALQ

SEQ ID NO: 474 - protein, 15 aa, Thermus thermophilus
  MOD_RES (5)..(5): Any amino acid
LALGXVDDRSLTVHT

SEQ ID NO: 475 - protein, 16 aa, Lachnospiraceae bacterium
DYEIIKAEESLQRDIS

SEQ ID NO: 476 - protein, 15 aa, Lachnospiraceae bacterium
LKSMLYSMRNSSFHF

SEQ ID NO: 477 - protein, 16 aa, Lachnospiraceae bacterium
LIKWCYLRERDLMYFQ

SEQ ID NO: 478 - protein, 14 aa, Lachnospiraceae bacterium
FRNEIDHFHYFYDR

SEQ ID NO: 479 - protein, 16 aa, Lachnospiraceae bacterium
DYELIKAEEMLQRETA

SEQ ID NO: 480 - protein, 15 aa, Lachnospiraceae bacterium
LKDVIYSMRNDSFHY

SEQ ID NO: 481 - protein, 16 aa, Lachnospiraceae bacterium
LINWIYLRERDLMNFQ

SEQ ID NO: 482 - protein, 14 aa, Lachnospiraceae bacterium
LRNYIEHFRYYSSF

SEQ ID NO: 483 - protein, 16 aa, Clostridium aminophilum
DYEQIRADETLQRQLS

SEQ ID NO: 484 - protein, 15 aa, Clostridium aminophilum
LRKAIYSLRNETFHF

SEQ ID NO: 485 - protein, 16 aa, Clostridium aminophilum
LISWSFLRERDLLYFQ

SEQ ID NO: 486 - protein, 14 aa, Clostridium aminophilum
VRKYVDHFKYYATS

SEQ ID NO: 487 - protein, 16 aa, Lachnospiraceae bacterium
DYEQIKADEMLQREVA

SEQ ID NO: 488 - protein, 15 aa, Lachnospiraceae bacterium
IIQIIYSLRNKSFHF

SEQ ID NO: 489 - protein, 16 aa, Lachnospiraceae bacterium
LISWSYLRERDLLYFQ

SEQ ID NO: 490 - protein, 14 aa, Lachnospiraceae bacterium
LRKYVDHFKYYAYG

SEQ ID NO: 491 - protein, 16 aa, Carnobacterium gallinarum
KLQEIGIYEGFQTKFM

SEQ ID NO: 492 - protein, 15 aa, Carnobacterium gallinarum
LRGSVQQIRNEIFHS

SEQ ID NO: 493 - protein, 16 aa, Carnobacterium gallinarum
MVGFSALFERDLVYFS

SEQ ID NO: 494 - protein, 14 aa, Carnobacterium gallinarum
IRNQTAHLSVLQLE

SEQ ID NO: 495 - protein, 16 aa, Carnobacterium gallinarum
TLQEIGMYEGTQTKFM

SEQ ID NO: 496 - protein, 15 aa, Carnobacterium gallinarum
IRGAVQRVRNQIFHQ

SEQ ID NO: 497 - protein, 16 aa, Carnobacterium gallinarum
MVGFSVLFERDFVYMG

SEQ ID NO: 498 - protein, 14 aa, Carnobacterium gallinarum
IRNNIAHLHVLRND

SEQ ID NO: 499 - protein, 16 aa, Paludibacter propionicigenes
DLIRIKTNEAFVLNLT

SEQ ID NO: 500 - protein, 15 aa, Paludibacter propionicigenes
IRGAVQQIRNNVNHY

SEQ ID NO: 501 - protein, 16 aa, Paludibacter propionicigenes
MAGFVALFDRDFQFFD

SEQ ID NO: 502 - protein, 14 aa, Paludibacter propionicigenes
IRNHIAHFNYLTKD

SEQ ID NO: 503 - protein, 16 aa, Listeria seeligeri
SLQKIKIEEAFALKFI

SEQ ID NO: 504 - protein, 15 aa, Listeria seeligeri
LRGAIAPIRNEIIHL

SEQ ID NO: 505 - protein, 16 aa, Listeria seeligeri
LAGYMSIADRDFQFSS

SEQ ID NO: 506 - protein, 14 aa, Listeria seeligeri
KRNNISHFNYLNGQ

SEQ ID NO: 507 - protein, 16 aa, Listeria weihenstephanensis
DLQDIRSGEAFSFKFI

SEQ ID NO: 508 - protein, 15 aa, Listeria weihenstephanensis
IRGSIQQIRNEVYHC

SEQ ID NO: 509 - protein, 16 aa, Listeria weihenstephanensis
YVGYVAIADRDFQCMA

SEQ ID NO: 510 - protein, 14 aa, Listeria weihenstephanensis
ARNHIAHLNYLSLK

SEQ ID NO: 511 - protein, 16 aa, Listeria newyorkensis
DLQDIRSGEAFSFKFI

SEQ ID NO: 512 - protein, 15 aa, Listeria newyorkensis
IRGSIQQIRNEVYHC

SEQ ID NO: 513 - protein, 16 aa, Listeria newyorkensis
YVGYVAIADRDFQCMA

SEQ ID NO: 514 - protein, 14 aa, Listeria newyorkensis
ARNHIAHLNYLSLK

SEQ ID NO: 515 - protein, 16 aa, Leptotrichia wadei
DLEYIKTKETLIRKMA

SEQ ID NO: 516 - protein, 15 aa, Leptotrichia wadei
ISYSIYNVRNGVGHF

SEQ ID NO: 517 - protein, 16 aa, Leptotrichia wadei
NVAFFNKWERDFKFIV

SEQ ID NO: 518 - protein, 14 aa, Leptotrichia wadei
FRNYIAHFLHLHTK

SEQ ID NO: 519 - protein, 16 aa, Leptotrichia wadei
INMRNRQTEAFLRSII

SEQ ID NO: 520 - protein, 15 aa, Leptotrichia wadei
MLNAITSIRHRVVHY

SEQ ID NO: 521 - protein, 16 aa, Leptotrichia wadei
LAGYTSLWERDLQFKL

SEQ ID NO: 522 - protein, 14 aa, Leptotrichia wadei
IRNYIAHFNYIPDA

SEQ ID NO: 523 - protein, 16 aa, Leptotrichia wadei
FIARNRQNEAFLRNII

SEQ ID NO: 524 - protein, 15 aa, Leptotrichia wadei
IDEAISSIRHGIVHF

SEQ ID NO: 525 - protein, 16 aa, Leptotrichia wadei
LVGYTSIWERDLRFRL

SEQ ID NO: 526 - protein, 14 aa, Leptotrichia wadei
IRNYIAHFNYIPHA

SEQ ID NO: 527 - protein, 16 aa, Rhodobacter capsulatus
GQTEIKESEIFVRLWV

SEQ ID NO: 528 - protein, 15 aa, Rhodobacter capsulatus
LLRYLRGCRNQTFHL

SEQ ID NO: 529 - protein, 16 aa, Rhodobacter capsulatus
LIDYAGAYERDTGTFL

SEQ ID NO: 530 - protein, 14 aa, Rhodobacter capsulatus
TRKDLAHFNVLDRA

SEQ ID NO: 531 - protein, 16 aa, Leptotrichia buccalis
FIARNRQNEAFLRNII

SEQ ID NO: 532 - protein, 15 aa, Leptotrichia buccalis
IDEAISSIRHGIVHF

SEQ ID NO: 533 - protein, 16 aa, Leptotrichia buccalis
LVGYTSIWERDLRFRL

SEQ ID NO: 534 - protein, 14 aa, Leptotrichia buccalis
IRNYIAHFNYIPHA

SEQ ID NO: 535 - protein, 16 aa, Leptotrichia sp.
FIVGNRQNEAFLRNII

SEQ ID NO: 536 - protein, 15 aa, Leptotrichia sp.
IDEAISSIRHGIVHF

SEQ ID NO: 537 - protein, 16 aa, Leptotrichia sp.
LVGYTSIWERDLRFRL

SEQ ID NO: 538 - protein, 14 aa, Leptotrichia sp.
IRNYIAHFNYIPNA

SEQ ID NO: 539 - protein, 16 aa, Leptotrichia sp.
DFSRLHAKEELDLELI

SEQ ID NO: 540 - protein, 15 aa, Leptotrichia sp.
FQKEGYLLRNKILHN

SEQ ID NO: 541 - protein, 16 aa, Leptotrichia sp.
LAIQMARFERDMHYIV

SEQ ID NO: 542 - protein, 14 aa, Leptotrichia sp.
IRNYISHFYIVRNP

SEQ ID NO: 543 - protein, 16 aa, Leptotrichia shahii
DFSRLHAKEELDLELI

SEQ ID NO: 544 - protein, 15 aa, Leptotrichia shahii
FTKIGTNERNRILHA

SEQ ID NO: 545 - protein, 16 aa, Leptotrichia shahii
LAIQMARFERDMHYIV

SEQ ID NO: 546 - protein, 14 aa, Leptotrichia shahii
IRNYISHFYIVRNP

SEQ ID NO: 547 - protein, 18 aa, Leptotrichia shahii
IRKFTKIGTNERNRILHA

SEQ ID NO: 548 - protein, 15 aa, Leptotrichia shahii
SIRNYISHFYIVRNP

SEQ ID NO: 549 - protein, 18 aa, Lachnospiraceae bacterium
LYSLKSMLYSMRNSSFHF

SEQ ID NO: 550 - protein, 15 aa, Lachnospiraceae bacterium
IFRNEIDHFHYFYDR

SEQ ID NO: 551 - protein, 18 aa, Lachnospiraceae bacterium
LTDLKDVIYSMRNDSFHY

SEQ ID NO: 552 - protein, 15 aa, Lachnospiraceae bacterium
ELRNYIEHFRYYSSF

SEQ ID NO: 553 - protein, 18 aa, Clostridium aminophilum
ADDLRKAIYSLRNETFHF

SEQ ID NO: 554 - protein, 15 aa, Clostridium aminophilum
DVRKYVDHFKYYATS

SEQ ID NO: 555 - protein, 18 aa, Camobacterium gallinarum
IWALRGSVQQIRNEIFHS

SEQ ID NO: 556 - protein, 15 aa, Camobacterium gallinarum
KIRNQTAHLSVLQLE

SEQ ID NO: 557 - protein, 18 aa, Camobacterium gallinarum
LWAIRGAVQRVRNQIFHQ

SEQ ID NO: 558 - protein, 15 aa, Camobacterium gallinarum
EIRNNIAHLHVLRND

SEQ ID NO: 559 - protein, 18 aa, Paludibacter propionicigenes
LWGIRGAVQQIRNNVNHY

SEQ ID NO: 560 - protein, 15 aa, Paludibacter propionicigenes
DIRNHIAHFNYLTKD

SEQ ID NO: 561 - protein, 18 aa, Listeria weihenstephanensis
IWAIRGSIQQIRNEVYHC

SEQ ID NO: 562 - protein, 15 aa, Listeria weihenstephanensis
NARNHIAHLNYLSLK

SEQ ID NO: 563 - protein, 18 aa, Lachnospiraceae bacterium
IWAIRGSIQQIRNEVYHC

SEQ ID NO: 564 - protein, 15 aa, Lachnospiraceae bacterium
NARNHIAHLNYLSLK

SEQ ID NO: 565 - protein, 18 aa, Leptotrichia wadei
FANIDEAISSIRHGIVHF

SEQ ID NO: 566 - protein, 15 aa, Leptotrichia wadei
YIRNYIAHFNYIPHA

SEQ ID NO: 567 - protein, 18 aa, Rhodobacter capsulatus
VFALLRYLRGCRNQTFHL

SEQ ID NO: 568 - protein, 15 aa, Rhodobacter capsulatus
QTRKDLAHFNVLDRA

SEQ ID NO: 569 - protein, 18 aa, Rhodobacter capsulatus
VFALLRYLRGCRNQTFHL

SEQ ID NO: 570 - protein, 15 aa, Rhodobacter capsulatus
QTRKDLAHFNVLDRA

SEQ ID NO: 571 - protein, 18 aa, Rhodobacter capsulatus
VFALLRYLRGCRNQTFHL

SEQ ID NO: 572 - protein, 15 aa, Rhodobacter capsulatus
QTRKDLAHFNVLDRA

SEQ ID NO: 573 - protein, 18 aa, Leptotrichia wadei
FANIDEAISSIRHGIVHF

SEQ ID NO: 574 - protein, 15 aa, Leptotrichia wadei
YIRNYIAHFNYIPHA

SEQ ID NO: 575 - protein, 18 aa, Listeria seeligeri
SWGLRGAIAPIRNEIIHL

SEQ ID NO: 576 - protein, 15 aa, Listeria seeligeri
EKRNNISHFNYLNGQ

SEQ ID NO: 577 - protein, 6 aa, Artificial Sequence
  Synthetic
HHHHHH

What is claimed:

1. A non-naturally occurring or engineered composition comprising i) a Cas13a CRISPR-Cas effector protein fused to one or more localization signals, or one or more polynucleotide molecules encoding a Cas13a CRISPR-Cas effector protein fused to one or more localization signals; and ii) one or more nucleic acid components, the one or more nucleic acid components comprising a heterologous guide sequence that is capable of hybridizing to a target RNA sequence, whereby the effector protein forms a complex with the one or more nucleic acid components, the one or more nucleic acid components directs the complex to the target RNA sequence in a mammalian target locus and the complex binds to the target RNA sequence;
   wherein the Cas13a CRISPR-Cas effector protein is selected from Cas13a CRISPR-Cas proteins obtained from Eubacteriaceae bacterium CHKCI004, *Blautia* sp. Marseille-P2398, RNA-binding protein S1 *Chloroflexus aggregans, Demequina aurantiaca, Thalassospira* sp. TSL5-1, SAMN04487830_13920 *Pseudobutyrivibrio* sp. OR37, SAMN02910398_00008 *Butyrivibrio* sp. YAB3001, *Leptotrichia* sp. Marseille-P3007, *Bacteroides ihuae*, SAMN05216357_1045 Porphyromonadaceae bacterium KH3CP3RA, *Listeria riparia*, and *Insolitispirillum peregrinum*.

2. The composition of claim 1, wherein the Cas 13a effector protein comprises at least two Higher Eukaryote and Prokaryotes Nucleotide-binding (HEPN) domain.

3. The composition of claim 1, wherein at least the one or more nucleic acid components is engineered for use in modifying the mammalian target locus of interest comprising the target RNA sequence.

4. The composition of claim 1, wherein at least one of said one or more localization signals is a nuclear localization signal (NLS) or a nuclear export signal (NES).

5. The composition of claim 1, wherein the one or more polynucleotide molecules comprise one or more regulatory elements operably configured to express the polypeptides and/or the nucleic acid component(s).

6. The composition of claim 5, wherein the one or more regulatory elements comprise one or more promoters or one or more inducible promoters.

7. The composition of claim 1, wherein the Cas13a CRISPR-Cas effector protein is associated with one or more functional domains.

8. The composition of claim 1, wherein the effector protein contains one or more mutations within a HEPN Domain corresponding to R597A, H602A, R1278A, and/or H1283A of *Leptotrichia shahii*, or the corresponding amino acids in a Cas13a ortholog.

9. The composition of claim 1, wherein the nucleic acid component comprises a dual direct repeat sequence.

10. The composition of claim 1, wherein the one or more polynucleotide molecules are comprised within one or more vectors.

11. The composition of claim 10, wherein the one or more vectors are viral vectors.

12. The composition of claim 11, wherein the one or more viral vectors comprise one or more retroviral, lentiviral, adenoviral, adeno-associated or herpes simplex viral vectors.

13. The composition of claim 1, wherein the assembled complex is comprised in a delivery system.

14. The composition of claim 1, wherein the non-naturally occurring or engineered composition is delivered via a delivery vehicle comprising liposome(s), particle(s), exosome(s), microvesicle(s), a gene-gun or one or more viral vector(s).

15. A eukaryotic cell engineered to comprise or express, the composition or a component thereof of:
   a non-naturally occurring or engineered composition comprising
   i) a Cas13a CRISPR-Cas effector protein or one or more polynucleotide molecules encoding Cas13a CRISPR-Cas effector protein; and
   ii) one or more nucleic acid components, the one or more nucleic acid components comprising a heterologous guide sequence that is capable of hybridizing to a target RNA sequence, whereby the effector protein forms a complex with the one or more nucleic acid components, the one or more nucleic acid components directs the complex to the target RNA sequence in a mammalian target locus and the complex binds to the target RNA sequence;
   wherein the Cas13a CRISPR-Cas effector protein is selected from Cas13a CRISPR-Cas proteins obtained from Eubacteriaceae bacterium CHKCI004, *Blautia* sp. Marseille-P2398, RNA-binding protein S1 *Chloroflexus aggregans, Demequina aurantiaca, Thalassospira* sp. TSL5-1, SAMN04487830_13920 *Pseudobutyrivibrio* sp. OR37, SAMN02910398_00008 *Butyrivibrio* sp. YAB3001, *Leptotrichia* sp. Marseille-P3007, *Bacteroides ihuae*, SAMN05216357_1045

*Porphyromonadaceae bacterium* KH3CP3RA, *Listeria riparia*, and *Insolitispirillum* peregrinum.

16. The cell according to claim 15, wherein the cell comprises a mammalian cell.

17. A multicellular organism comprising one or more cells according to claim 15.

18. A plant or animal model comprising one or more cells according to claim 15, wherein said one or more cells express the composition or a component thereof.

19. A method of modifying a target sequence, the method comprising delivering to a locus of interest comprising the mammalian target sequence a non-naturally occurring or engineered composition comprising i) a Cas13a CRISPR-Cas effector protein fused to one or more localization signals, or one or more polynucleotide molecules encoding a Cas13a CRISPR-Cas effector protein fused to one or more localization signals; and
   ii) one or more nucleic acid components, the one or more nucleic acid components comprising a heterologous guide sequence that is capable of hybridizing to a target RNA sequence, whereby the effector protein forms a complex with the one or more nucleic acid components, the one or more nucleic acid components directs the complex to the target RNA sequence in a mammalian target locus and the complex binds to the target RNA sequence;
   wherein the Cas13a CRISPR-Cas effector protein is selected from Cas13a CRISPR-Cas proteins obtained from Eubacteriaceae bacterium CHKCI004, *Blautia* sp. Marseille-P2398, RNA-binding protein S1 *Chloroflexus aggregans, Demequina aurantiaca, Thalassospira* sp. TSL5-1, SAMN04487830_13920 *Pseudobutyrivibrio* sp. OR37, SAMN02910398_00008 *Butyrivibrio* sp. YAB3001, *Leptotrichia* sp. Marseille-P3007, *Bacteroides ihuae*, SAMN05216357_1045 *Porphyromonadaceae bacterium* KH3CP3RA, *Listeria riparia, Insolitispirillum peregrinum, Herbinix hemicellulosilityca*, and *Leptrotrichia buccalis* C-1013-b.

20. The method of claim 19, wherein the modification of the target sequence comprises a strand break.

21. The method of claim 19, wherein the Cas13a CRISPR-Cas effector protein is associated with one or more functional domains.

22. The method of claim 21, wherein the one or more functional domains modifies transcription or translation of the target locus.

23. The method of claim 21, wherein the effector protein contains one or more mutations within an HEPN Domain corresponding to R597A, H602A, R1278A, and/or H1283A H1283A of *Leptotrichia shahii*, or the corresponding amino acids in a Cas13a ortholog, whereby the complex can deliver an epigenetic modifier or a transcriptional or translational activation or repression signal.

24. The method of claim 19, wherein at least one of said one or more said localization signals is a nuclear localization signal (NLS) or a nuclear export signal (NES).

25. The method of claim 19, wherein the one or more polynucleotide molecules comprise one or more regulatory elements operably configured to express the polypeptides and/or the nucleic acid component(s).

26. The composition of claim 25, wherein the one or more regulatory elements comprise one or more promoters or one or more inducible promoters.

* * * * *

UNITED STATES PATENT AND TRADEMARK OFFICE
CERTIFICATE OF CORRECTION

| | | |
|---|---|---|
| PATENT NO. | : 11,788,083 B2 | |
| APPLICATION NO. | : 16/310577 | |
| DATED | : October 17, 2023 | |
| INVENTOR(S) | : Zhang et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 949 days.

In the Specification

In Column 9, Line 27, delete "1713," and insert -- I713, --.

In Column 9, Line 28, delete "1879," and insert -- I879, --.

In Column 9, Line 53, delete "157," and insert -- I57, --.

In Column 20, Line 22, delete "PLwC2c2" and insert -- βLwC2c2 --.

In Column 21, Line 48, delete "3I." and insert -- 31. --.

In Column 24, Line 32, delete "(0)" and insert -- (O) --.

In Column 28, Line 5, delete "a-helix" and insert -- α-helix --.

In Column 35, Line 2, delete "oxfordjoumals" and insert -- oxfordjournals --.

In Column 35, Line 23, delete "3-actin" and insert -- β-actin --.

In Column 38, Line 67, delete "11090." and insert -- I1090. --.

In Column 44, Line 66, delete "(A<→G or C<→U changes)" and insert

Signed and Sealed this
Fourteenth Day of May, 2024

Katherine Kelly Vidal
*Director of the United States Patent and Trademark Office*

CERTIFICATE OF CORRECTION (continued)
U.S. Pat. No. 11,788,083 B2

-- (A<->G or C<->U changes) --.

In Column 45, Line 17, delete "ADARI" and insert -- ADAR1 --.

In Column 46, Line 6, delete "3-actin" and insert -- β-actin --.

In Column 57, Line 4, delete "Shieldi" and insert -- Shield1 --.

In Column 58, Line 42, delete "Hamarnelidales," and insert -- Hamamelidales, --.

In Column 58, Line 47, delete "-Laloragales," and insert -- Haloragales, --.

In Column 58, Line 50, delete "Unmbellales," and insert -- Umbellales, --.

In Column 58, Line 50, delete "Polernoniales," and insert -- Polemoniales, --.

In Column 58, Line 53, delete "rnonocotyledonous" and insert -- monocotyledonous --.

In Column 58, Line 65, delete "AUseodaphne," and insert -- Alseodaphne, --.

In Column 58, Line 66, delete "Cartharnus," and insert -- Carthamus, --.

In Column 58, Line 67, delete "Cucunis," and insert -- Cucumis, --.

In Column 59, Lines 2-3, delete "Gossyphm, Helicanthus," and insert -- Gossypium, Helianthus, --.

In Column 59, Line 3, delete "Hyosvyainus," and insert -- Hyoscyamus, --.

In Column 59, Lines 4-5, delete "MaJinihot, Majorcina, Mlalus," and insert -- Manihot, Majorana, Malus, --.

In Column 59, Line 8, delete "Theobromwa," and insert -- Theobroma, --.

In Column 59, Line 10, delete "Cvnodon," and insert -- Cynodon, --.

In Column 59, Line 11, delete "Hemerocalhs, Hordeumn," and insert -- Hemerocallis, Hordeum, --.

In Column 59, Line 12, delete "Lohim," and insert -- Lolium, --.

In Column 59, Line 24, delete "Chlamydomionas," and insert -- Chlamydomonas, --.

In Column 62, Line 41, delete "part.," and insert -- part, --.

In Column 64, Line 5, delete "at," and insert -- al., --.

In Column 67, Line 22, delete "33" and insert -- β3 --.

CERTIFICATE OF CORRECTION (continued)
U.S. Pat. No. 11,788,083 B2

In Column 101, Lines 5-6, delete "(a-tocopherol)" and insert -- (α-tocopherol) --.

In Column 101, Line 21, delete "a-tocopherol" and insert -- α-tocopherol --.

In Column 106, Line 45, delete "1xPBS;" and insert -- 1x PBS; --.

In Column 106, Line 58, delete "poly(O-amino ester)" and insert -- poly(β-amino ester) --.

In Column 110, Line 11, delete "mmol/1." and insert -- mmol/l. --.

In Column 110, Line 12, delete "mmol/1" and insert -- mmol/l --.

In Column 110, Line 19, delete "mmol/1" and insert -- mmol/l --.

In Column 110, Line 52, delete "mmol/1," and insert -- mmol/l, --.

In Column 111, Line 2, delete "m" and insert -- μm --.

In Column 117, Line 33, delete "3-N-[(o" and insert -- 3-N-[(ω --.

In Column 117, Line 54, delete "3-N-[(o" and insert -- 3-N-[(ω --.

In Column 119, Line 9, delete "Na₂HlPO₄," and insert -- Na$_2$HPO$_4$, --.

In Column 119, Line 18, delete "m" and insert -- μm --.

In Column 119, Line 61, delete "C$_{12-200}$" and insert -- C12-200 --.

In Column 120, Line 1, delete "C$_{12-200}$" and insert -- C12-200 --.

In Column 120, Line 4, delete "C$_{12-200}$" and insert -- C12-200 --.

In Column 122, Line 34, delete "+36" and insert -- Þ36 --.

In Column 122, Line 40, delete "36" and insert -- Þ36 --.

In Column 122, Line 42, delete "370 C" and insert -- 37° C. --.

In Column 132, Line 40, delete "500" and insert -- 50° --.

In Column 137, Line 46, delete "P-alanine" and insert -- β-alanine --.

In Column 137, Line 51, delete "a-carbon" and insert -- α-carbon --.

In Column 141, Line 12, delete "1id" and insert -- 11d --.

CERTIFICATE OF CORRECTION (continued)
U.S. Pat. No. 11,788,083 B2

In Column 141, Line 66, delete "a-fetoprotein" and insert -- α-fetoprotein --.

In Column 150, Line 12, delete "B-galactosidase," and insert -- β-galactosidase, --.

In Column 163, Line 17, delete "Hepalclc7," and insert -- Hepa1c1c7, --.

In Column 173, Line 37, delete "Alzheime's" and insert -- Alzheimer's --.

In Column 173, Line 46, delete " (SMNA7)." and insert -- (SMNΔ7). --.

In Column 184, Line 7, delete "0," and insert -- O, --.

In Column 189, Line 1, delete "1xPBS." and insert -- 1x PBS. --.

In Column 189, Line 42, delete "P-lactamase" and insert -- β-lactamase --.

In Column 190, Line 33, delete "seeliged" and insert -- seeligeri --.

In Column 201, Line 47, delete "tagattgctgactaccaagtaatecat" and insert -- tagattgctgttctaccaagtaatccat --.

In Column 205, Lines 61-62, delete "CRISPRRNA." and insert -- CRISPR RNA. --.

In Column 206, Line 56, delete "thatLwaCas13a" and insert -- that LwaCas13a --.

In Column 208, Line 57, delete "XTST" and insert -- XIST --.

In Column 213, Line 45, delete "FASEBJ24," and insert -- FASEB J 24, --.

In Column 217, Line 2, delete "andMcNaughton," and insert -- and McNaughton, --.

In Column 288, Line 24, delete "K558" and insert -- D558 --.

In Column 290, Line 18, delete "2xMaster" and insert -- 2X Master --.

In Column 291, Line 25, delete "algorithm[37]." and insert -- algorithm[87]. --.

In Column 291, Line 48, delete "described[80]" and insert -- described[89] --.

In Column 292, Line 52, delete "(Os06 g04280)," and insert -- (Os06g04280), --.

In Column 292, Line 55, delete "(Os11 g07960)," and insert -- (Os11g07960), --.

In Column 292, Line 58, delete "(Os03 g08020)," and insert -- (Os03g08020), --.

In Column 293, Line 64, delete "(GAPDIH)" and insert -- (GAPDH) --.

CERTIFICATE OF CORRECTION (continued)
U.S. Pat. No. 11,788,083 B2

In Column 295, Line 21, delete "1xRIPA" and insert -- 1X RIPA --.

In Column 295, Line 36, delete "M703)" and insert -- M7023) --.

In Column 295, Line 48, delete "1xRIPA" and insert -- 1X RIPA --.

In Column 295, Line 53, delete "1xRIPA," and insert -- 1X RIPA, --.

In Column 295, Line 58, delete "370 C" and insert -- 37° C. --.

In Column 300, Line 40, delete "weihenstephaensis ESL" and insert -- weihenstephanensis FSL --.